US008658358B1

(12) United States Patent
Salisbury et al.

(10) Patent No.: US 8,658,358 B1
(45) Date of Patent: Feb. 25, 2014

(54) MUTATIONS ASSOCIATED WITH LONG QT SYNDROME

(75) Inventors: Benjamin Salisbury, Dayton, OH (US); Carole L. Harris-Kerr, North Haven, CT (US)

(73) Assignee: Transgenomic, Inc., Omaha, NE (US)

( * ) Notice: Subject to any disclaimer, the term of this patent is extended or adjusted under 35 U.S.C. 154(b) by 433 days.

(21) Appl. No.: 12/764,841

(22) Filed: Apr. 21, 2010

Related U.S. Application Data

(60) Provisional application No. 61/214,239, filed on Apr. 21, 2009.

(51) Int. Cl.
*C12Q 1/68* (2006.01)
(52) U.S. Cl.
USPC .......................................................... 435/6.1
(58) Field of Classification Search
None
See application file for complete search history.

(56) References Cited

U.S. PATENT DOCUMENTS

2005/0142591 A1    6/2005   Ackerman

OTHER PUBLICATIONS

Tester, David J., et al. Compendium of cardiac channel mutations in 541 consecutive unrelated patients referred for long QT syndrome genetic testing; Heart Rhythm; May 2005, vol. 2 (5):507-17.
Napolitano, Carlo, et al. Genetic Testing in the Long QT Syndrome: development and validation of an efficient approach to genotyping in clinical practice. JAMA. Dec. 21, 2005; vol. 294 (23):2975-80.
Asada, Ken, et al. Redox- and Calmodulin-Dependent S-Nitrosylantion of the KCNQ1 Channel, J Biol Chem. Feb. 27, 2009;284(9):6014-20.

*Primary Examiner* — Juliet Switzer
(74) *Attorney, Agent, or Firm* — McCarter & English, LLP; Jill Mello

(57) ABSTRACT

The invention is based, at least in part, on the observation that the presence of particular biomarkers, e.g., particular mutations in any of the KCNQ1, KCNH2, SCN5A, KCNE1 and KCNE2 genes as identified in Tables 1-5 (and, in particular, those identified with an asterisk), is associated with Long QT Syndrome (LQTS).

4 Claims, No Drawings

MUTATIONS ASSOCIATED WITH LONG QT SYNDROME

RELATED APPLICATIONS

This application claims priority to U.S. Provisional Application No. 61/214,239, filed Apr. 21, 2009, the entire contents of which are hereby incorporated by reference.

SUBMISSION ON COMPACT DISC

This application incorporates by reference the ASCII text file identified by the name 118553-21901 ST25.txt, containing 1.02 MB of data, created on Jun. 6, 2010 and filed in computer-readable format (CRF).

BACKGROUND OF THE INVENTION

The measurement of the contraction of the heart on an electrocardiogram (ECG) produces a waveform with characteristic elements which correspond to the various stages of contraction. One feature of an ECG is referred to as the QT interval, which represents the time period between the initiation of ventricular depolarization and completion of repolarization. The QT interval varies with the heart rate, age and gender. For example, the QT interval decreases with increasing heart rate. Men generally have shorter QT intervals than women.

Under certain circumstances, the QT interval can be prolonged, increasing the risk of a potentially fatal cardiac arrhythmia, resulting in the inability of the heart to contract effectively, which leads to a decrease in blood flow to periphery, including the brain, and syncope or sudden death. In rare cases, a prolonged QT interval is congenital and usually inherited. In other cases, prolongation of the QT interval is the result of a neurological disorder, such as stroke. Most frequently, a prolonged QT interval is caused by certain medications.

Congenital long QT syndrome (LQTS) comprises a distinct group of cardiac channelopathies characterized by QT prolongation on a 12-lead surface electrocardiogram (ECG) and increased risk for syncope, seizures, and sudden cardiac death (SCD) in the setting of a structurally normal heart and otherwise healthy individual. The incidence of LQTS may be as high as 1 in 2500 persons.

Because 2.5% of healthy individuals have a prolonged QT interval and 10-15% of LQTS patients have a normal QT interval, LQTS is not easily diagnosed and subsequently treated.

SUMMARY OF THE INVENTION

The invention is based, at least in part, on the observation that the presence of particular biomarkers, e.g., particular mutations in any of the KCNQ1, KCNH2, SCN5A, KCNE1 and KCNE2 genes as identified in Tables 1-5 (and, in particular, those identified with an asterisk), are associated with Long QT Syndrome (LQTS). Accordingly, the present invention provides methods and compositions for identifying subjects having or susceptible to having LQTS. In addition, the present invention provides methods and compositions for predicting the responsiveness of a subject having or predisposed to having LQTS, e.g., a human subject, to treatment for LQTS therapy. The methods include determining the presence or absence of the biomarkers in a biological sample obtained from the subject, wherein the presence of at least one of the biomarkers as set forth in any of Tables 1-5 is an indication that the subject will respond to LQTS therapy, thereby predicting responsiveness of the subject to the LQTS therapy.

The present invention provides a method for identifying whether a subject suffers from or is predisposed to suffer from congenital long QT syndrome (LQTS). In one aspect, the method for identifying whether a subject suffers from or is predisposed to suffer from congenital long QT syndrome (LQTS) includes identifying the presence of at least one biomarker in a biological sample obtained from the subject, wherein the biomarker is selected from the group consisting of variants set forth in Tables 1-5.

In one embodiment, the biomarker is a variant in at least one of the KCNQ1 (LQT1), KCNH2 (LQT2), SCN5A (LQT3), KCNE1 or KCNE2 genes. In another embodiment, the variant is selected from the group consisting of a mutation, a missense mutation, a nonsense mutation, an insertion, a deletion, or a frameshift mutation. In another embodiment, the variant disrupts the open reading frame of the KCNQ1, KCNH2, SCN5A, KCNE1 or KCNE2 genes. In another embodiment, the variant disrupts the canonical splice site of the KCNQ1, KCNH2, SCN5A, KCNE1 or KCNE2 genes. In another embodiment, the variant disrupts the splice acceptor sequence of the KCNQ1, KCNH2, SCN5A, KCNE1 or KCNE2 genes. In another embodiment, the variant disrupts the splice donor recognition sequence of the KCNQ1, KCNH2, SCN5A, KCNE1 or KCNE2 genes. In yet another embodiment, the biomarker is a L266P mutation in KCNQ1, a R518X mutation in KCNQ1, a R594Q mutation in KCNQ1, a G168R mutation in KCNQ1 or a E1784K mutation in SCN5A. In certain embodiments, the biomarker is a nonsense mutation in SCN5A selected from the group consisting of Q73X, R179X, R222X, Y389X and W1798X. In another embodiment, the biomarker is a frameshift mutation in SCN5A selected from the group consisting of V850fs+18X and L1786fs+45X.

The present invention also provides a method for predicting therapeutic responsiveness of a subject having LQTS or susceptible to having LQTS to LQTS therapy. In one aspect, the method includes determining the presence or absence of at least one biomarker in a biological sample obtained from the subject, wherein the biomarker is selected from the group consisting of variants set forth in Tables 1-5, and wherein the presence of the at least one biomarker in the sample is an indication that the subject will respond to the LQTS therapy, thereby predicting responsiveness of the subject to the LQTS therapy.

In one embodiment, the LQTS therapy includes a method selected from the group consisting of administration of beta receptor blocking agents, implantation of an implantable cardioverter-defibrillator (ICD), potassium supplementation, administration of a sodium channel blocker such as mexiletine, and amputation of the cervical sympathetic chain.

In one embodiment, determining the presence or absence of at least one biomarker is accomplished using a technique selected from the group consisting of polymerase chain reaction (PCR) amplification reaction, reverse-transcriptase PCR analysis, single-strand conformation polymorphism analysis (SSCP), mismatch cleavage detection, heteroduplex analysis, Southern blot analysis, Western blot analysis, deoxyribonucleic acid sequencing, restriction fragment length polymorphism analysis, haplotype analysis, serotyping, and combinations or sub-combinations thereof, of said sample. In one embodiment, the sample comprises a fluid obtained from the subject. For example, the fluid may be a blood fluid, vomit, intra-articular fluid, saliva, lymph, cystic fluid, urine, fluid collected by bronchial lavage, fluid collected by peritoneal rinsing, or gynecological fluid. In another embodiment, the sample is a blood sample or a component thereof. In another embodiment, the sample comprises a tissue or component thereof obtained from the subject. For example, the tissue may be bone, connective tissue, cartilage, lung, liver, kidney, muscle tissue, heart, pancreas, or skin. In one embodiment, the subject is a human.

In one embodiment, the biomarker is a variant in at least one of the KCNQ1 (LQT1), KCNH2 (LQT2), SCN5A (LQT3), KCNE1 or KCNE2 genes. In another embodiment, the variant is selected from the group consisting of a mutation, a missense mutation, a nonsense mutation, an insertion, a deletion, or a frameshift mutation. In another embodiment, the variant disrupts the open reading frame of the KCNQ1, KCNH2, SCN5A, KCNE1 or KCNE2 genes. In another embodiment, the variant disrupts the canonical splice site of the KCNQ1, KCNH2, SCN5A, KCNE1 or KCNE2 genes. In another embodiment, the variant disrupts the splice acceptor sequence of the KCNQ1, KCNH2, SCN5A, KCNE1 or KCNE2 genes. In another embodiment, the variant disrupts the splice donor recognition sequence of the KCNQ1, KCNH2, SCN5A, KCNE1 or KCNE2 genes. In yet another embodiment, the biomarker is a L266P mutation in KCNQ1, a R518X mutation in KCNQ1, a R594Q mutation in KCNQ1, a G168R mutation in KCNQ1 or a E1784K mutation in SCN5A. In certain embodiments, the biomarker is a nonsense mutation in SCN5A selected from the group consisting of Q73X, R179X, R222X, Y389X and W1798X. In another embodiment, the biomarker is a frameshift mutation in SCN5A selected from the group consisting of V850fs+18X and L1786fs+45X.

The present invention also provides a kit for predicting responsiveness of a subject having LQTS or susceptible to having LQTS to LQTS therapy. In one aspect, the kit includes means for determining the presence or absence of at least one biomarker in a biological sample obtained from the subject, wherein the biomarker is selected from the group consisting of variants set forth in Tables 1-5, and instructions for use of the kit to predict responsiveness of the subject having LQTS to LQTS therapy. In one embodiment, the kit further includes means for obtaining a biological sample from a subject. In another embodiment, the kit further includes a control sample, for example, a nucleic acid molecule encoding any of SEQ ID NOs:1-5.

The present invention also provides a nucleic acid molecule including a variant of the KCNQ1 (LQT1), KCNH2 (LQT2), SCN5A (LQT3), KCNE1 or KCNE2 genes selected from the group consisting of the variants set forth in Tables 1-5.

DETAILED DESCRIPTION OF THE INVENTION

The invention is based, at least in part, on the observation that the presence of particular biomarkers, e.g., particular mutations in any of the KCNQ1, KCNH2, SCN5A, KCNE1 and KCNE2 genes as identified in Tables 1-5 (and, in particular, those identified with an asterisk), are associated with Long QT Syndrome (LQTS). Accordingly, the present invention provides methods and compositions for identifying subjects having or susceptible to having LQTS. Specifically, by identifying the variants of the KCNQ1, KCNH2, SCN5A, KCNE1 and KCNE2 genes disclosed herein in biological samples derived from a subject, one can identify the subject as having or predisposed to having LQTS.

In addition, the present invention provides methods and compositions for predicting the responsiveness of a subject having or predisposed to having LQTS, e.g., a human subject, to treatment for LQTS therapy. The methods include determining the presence or absence of the biomarkers in a biological sample obtained from the subject, wherein the presence of at least one of the biomarkers as set forth in any of Tables 1-5 is an indication that the subject will respond to LQTS therapy, thereby predicting responsiveness of the subject to the LQTS therapy.

In order that the present invention may be more readily understood, certain terms are first defined.

As used herein, the term "long QT syndrome" or "LQTS" refers to a rare inborn heart condition in which delayed repolarization of the heart following a heartbeat increases the risk of episodes of torsade de pointes (a form of irregular heartbeat that originates from the ventricles). These episodes may lead to palpitations, fainting and sudden death due to ventricular fibrillation. Episodes may be provoked by various stimuli, depending on the subtype of the condition.

As used herein, the term "biomarker" is intended to encompass an indicator of a biologic state and includes genes (and nucleotide sequences of such genes), mRNAs (and nucleotide sequences of such mRNAs) and proteins (and amino acid sequences of such proteins). A "biomarker expression pattern" is intended to refer to a quantitative or qualitative summary of the expression of one or more biomarkers in a subject, such as in comparison to a standard or a control.

As used herein, biomarkers encompass variants of the KCNQ1, KCNH2, SCN5A, KCNE1 and KCNE2 genes as set forth in Tables 1-5. For example, biomarkers include mutations, missense mutations, nonsense mutations, insertions, deletions, or frameshift mutations in at least one of these genes. The biomarkers may serve to disrupt the open reading frame of the KCNQ1, KCNH2, SCN5A, KCNE1 or KCNE2 genes and/or the canonical splice site, for example, the splice acceptor sequence or splice donor recognition sequences, of the KCNQ1, KCNH2, SCN5A, KCNE1 or KCNE2 genes.

In particular embodiments, the biomarker is any one of a L266P mutation in KCNQ1, a R518X mutation in KCNQ1, a R594Q mutation in KCNQ1, a G168R mutation in KCNQ1, or a E1784K mutation in SCN5A. Alternatively or in addition, the biomarker may be a nonsense mutation in SCN5A selected from the group consisting of Q73X, R179X, R222X, Y389X and W1798X. In other embodiments, the biomarker may be a frameshift mutation in SCN5A selected from the group consisting of V850fs+18X and L1786fs+45X.

The terms "increased" or "increased expression" and "decreased" or "decreased expression", with respect to the expression pattern of a biomarker(s), are used herein as meaning that the level of expression is increased or decreased relative to a constant basal level of expression of a household, or housekeeping, gene, whose expression level does not significantly vary under different conditions. A nonlimiting example of such a household, or housekeeping, gene is GAPDH. Other suitable household, or housekeeping, genes are well-established in the art.

As set forth below, the KCNQ1, KCNH2, SCN5A, KCNE1 or KCNE2 genes generally encode the major pore-forming alpha subunits of the macromolecular channel complexes Kv7.1 ($I_{KS}$), Kv11.1 ($I_{Kr}$) and Nav1.5 ($I_{Na}$).

As used herein, the term KCNQ1 (LQT1) refers to the gene encoding the voltage-gated potassium channel KvLQT1 that is highly expressed in the heart. It is believed that the product of the KCNQ1 gene produces an alpha subunit that interacts with other proteins (particularly the minK beta subunit) to create the $I_{Ks}$ ion channel, which is responsible for the delayed potassium rectifier current of the cardiac action potential. The KCNQ1 gene has been isolated to chromosome 11p15.5. The nucleotide sequence for KCNQ1 is set forth in SEQ ID NO:1.

As used herein, the term KCNH2 (LQT2), also known as human ether-a-go-go related gene (HERG), on chromosome 7 is part of the rapid component of the potassium rectifying current (W. The $I_{Kr}$ current is mainly responsible for the termination of the cardiac action potential, and therefore the length of the QT interval. Normally functioning HERG gene allows protection against early after depolarizations (EADs). Specifically, KCNH2 refers to the gene encoding potassium voltage-gated channel, subfamily H (eag-related), member 2. The nucleotide sequence for KCNH2 is set forth in SEQ ID NO:2.

As used herein, the term SCN5A (LQT3) (also hH1 and $Na_v1.5$) refers to the gene encoding sodium channel, voltage-gated, type V, alpha subunit. This gene is located on chromosome 3p21-24, and is known as SCN5A. The nucleotide sequence for SCN5A is set forth in SEQ ID NO:3. The mutations slow the inactivation of the $Na^+$ channel, resulting in prolongation of the $Na^+$ influx during depolarization. Paradoxically, the mutant sodium channels inactivate more quickly, and may open repetitively during the action potential.

As used herein, the term KCNE1 refers to the gene encoding potassium voltage-gated channel, Isk-related family, member 1 (potassium channel beta subunit MinK) The nucleotide sequence for KCNE1 is set forth in SEQ ID NO:4.

As used herein, the term KCNE2 refers to the gene encoding potassium voltage-gated channel, Isk-related family, member 2 (potassium channel beta subunit MiRP1, constituting part of the $I_{Kr}$ repolarizing $K^+$ current). The nucleotide sequence for KCNE2 is set forth in SEQ ID NO:5.

As used herein, the term "subject" includes humans, and non-human animals amenable to LQTS therapy, e.g., preferably mammals, such as non-human primates, sheep, dogs, cats, horses and cows.

As used herein, the term "treatment regimen" is intended to refer to one or more parameters selected for the treatment of a subject, e.g., by administering beta receptor blocking agents, which parameters can include, but are not necessarily limited to, the type of agent chosen for administration, the dosage, the formulation, the route of administration and the frequency of administration.

LQTS therapy includes, but is not limited to, administration of beta receptor blocking agents, implantation of an implantable cardioverter-defibrillator (ICD), potassium supplementation, administration of a sodium channel blocker such as mexiletine, and amputation of the cervical sympathetic chain.

The term "predicting responsiveness to LQTS therapy", as used herein, is intended to refer to an ability to assess the likelihood that treatment of a subject with LQTS therapy will or will not be effective in (e.g., provide a measurable benefit to) the subject. In particular, such an ability to assess the likelihood that treatment will or will not be effective typically is exercised before LQTS treatment is begun in the subject.

However, it is also possible that such an ability to assess the likelihood that treatment will or will not be effective can be exercised after treatment has begun but before an indicator of effectiveness (e.g., an indicator of measurable benefit) has been observed in the subject.

The present invention is further illustrated by the following examples which should not be construed as further limiting. The contents of all references, patents and published patent applications cited throughout this application are expressly incorporated herein by reference in their entirety.

EXAMPLES

Example 1

Identification of Biomarkers Associated with LQTS

Between May 2004 and October 2008, 2500 unrelated patients (1515 females, average age at testing=26±17 years and 985 males, average age at testing=19±15 years) were tested for LQTS by PGxHealth, LLC in New Haven, Conn. Patient genomic DNA was analyzed for mutations in all 60 translated exons and their canonical splice site regions of KCNQ1, KCNH2, SCN5A, KCNE1, and KCNE2 using polymerase chain reaction (PCR) and automated DNA sequencing. All PCR primers were designed with special care to avoid the phenomenon of allelic dropout, which can lead to a false negative genetic test result. Insertions and deletions that span an amplicon or interfere with amplification are not detected. Reference sequences for KCNQ1, KCNH2, SCN5A, KCNE1, and KCNE2 are provided as, respectively, SEQ ID NO:1, SEQ ID NO:2, SEQ ID NO:3, SEQ ID NO:4, and SEQ ID NO:5.

All putative LQTS-associated mutations and other variants were denoted using known and accepted nomenclature. For example, the single letter amino acid code was used to designate missense mutations (single amino acid substitutions) using the L250P format. Here, at amino acid position 250, the 'wild type' amino acid (L=leucine) is replaced by a proline (P) on one of the chromosomes. Frameshift mutations resulting from nucleotide insertions or deletions were annotated using the R174fs+105X format. Here, R174 represents the last properly encoded amino acid followed by a frameshift (fs) in the coding sequence resulting in 105 miscoded amino acids prior to reaching a stop codon (X) resulting in a truncated protein containing a total of 279 amino acids.

A substitution of either the first two or the last two nucleotides of a particular exon has the capacity to alter proper mRNA splicing, regardless of whether the nucleotide substitution codes for a different amino acid (missense mutation), produces a stop codon (nonsense mutation) or does not alter the open reading frame at all (i.e., a synonymous or silent single nucleotide substitution). As such, mutations involving this exonic portion of the "splice site" were considered as possible splicing mutations in this study and annotated as either "missense/splice," "nonsense/splice," or "silent/splice" mutations in order to distinguish them from intronic mutations predicted to disrupt splicing.

Topological placement of the mutations was done using a combination of Swissprot (http://ca.expasy.org/uniprot/) and recent studies of the linear topologies for each of the three main pore-forming alpha subunits. The Swissprot database provides generally accepted residue ranges corresponding with each ion-channel region and specialized sub-regions. To be considered as a potential LQTS-causing mutation, the variant should disrupt the open reading frame (i.e., missense, nonsense, insertion/deletion, or frameshift mutations) or the canonical splice site (splice acceptor or splice donor recognition sequences). In addition to the exonic splice sites described above, the canonical acceptor splice site was defined as the seven intronic nucleotides, except the fourth, preceding an exon (designated as IVS−1, −2, −3, −5, −6, or −7) and the donor splice site as the first five intronic nucleotides following an exon (designated as IVS+1, +2, +3, +4, or +5). Hence, single nucleotide substitutions that did not change the open reading frame (i.e., synonymous single nucleotide polymorphisms/variants) and intronic nucleotide substitutions located outside of the canonical splice site recognition sequence (i.e., beyond IVS−5 or IVS+5) were excluded from consideration.

Additionally, the candidate mutation must not have been observed in a panel of now over 1300 ostensibly healthy volunteers (>2600 reference alleles). As such, the sole or concurrent presence of common or rare non-synonymous single nucleotide polymorphisms like P448R-KCNQ1, R176W-KCNH2, H558R-SCN5A, D85N-KCNE1, or Q9E-KCNE2 would not be designated as a pathogenic mutation resulting in LQT1, LQT2, LQT3, LQT5, or LQT6 respectively, despite there being evidence of slight abnormality or risk associated with some of these. Further, such polymorphisms would not be counted towards the assignment of compound or multiple mutation status to an individual.

The genes causative of the major LQTS subtypes encode ion channel subunits with regions that span the cell membrane to allow ions to flow in or out of the cell, as well as functional domains that regulate the passage of these ions. The probability that a novel missense mutation identified in a LQTS patient is pathogenic is directly related to the position of the mutation within the protein. The protein encoded by KCNQ1 has a transmembrane domain region that consist of 6 transmembrane spanning domains annotated S1 through S6, and each domain is connected by a small linker region named according the domains that it connects (i.e., the first linker domain is named S1/S2). The entire transmembrane domain region of KCNQ1 protein is flanked by non-transmembrane regions referred to as the N-terminus and C-terminus. Within the C-terminus region of KCNQ1, a regulatory domain called the Subunit Assembly Region (SAR) exists. Similar for the proteins encoded by KCNH2, SCN5A, KCNE1, and KCNE2, transmembrane domain regions are also flanked by N-termini and C-termini. Specifically, KCNH2 protein has 6 transmembrane spanning domains referred to S1 through S6, linker domains connecting theses transmembrane spanning domains, regulatory domains within the N-terminus called the Per-Arnt-Sim (PAS) domain and the PAS-associated C-terminal domain (PAC), and one regulatory domain within the C-terminus called the Cyclic nucleotide binding domain (cNBD). The protein region in KCNH2 that is located between and including the S5 and S6 transmembrane domains is specifically referred to as the Pore region. SCN5A protein consists of 4 sets of the 6 transmembrane spanning domains referred to as DI through DIV and linker domains connecting each transmembrane spanning segment. The proteins encoded by KCNE1 and KCNE1 each contain a single transmembrane domain flanked by N- and C-termini. The specific location of a mutation in the complex of structure of these LQTS causative genes is directly related to the likelihood of its pathogenicity. Missense mutations that localize to the pore domain, transmembrane-spanning domains (e.g. S1-S6), or other critical subdomains (i.e., PAS, PAC, cNBD, and SAR) confer a high probability for causing LQTS.

Overall, 903/2500 (36%) unrelated cases had a positive genetic test with the identification of a putative LQTS-causing mutation that was absent in over 2600 reference alleles. Among the 903 genotype-positive patients, 821 (91%) had a single mutation: 386 in KCNQ1 (43%), 288 in KCNH2 (32%), 115 in SCN5A (13%), 24 in KCNE1, and 8 in KCNE2.

The remaining 82 patients (9%) had >1 mutation including 30 cases with multiple mutations in the same gene: KCNQ1 (19), KCNH2 (3), SCN5A (6), KCNE1 (1), and KCNE2 (1). Fifty-two cases were compound heterozygous with mutations in >1 gene.

In total, the 903 genotype-positive cases stemmed from 562 distinct LQTS-causing mutations: 199 distinct mutations in KCNQ1, 226 in KCNH2, 110 in SCN5A, 18 in KCNE1, and 9 in KCNE2 (Tables 1-5). Notably, over half of the mutations (336/562, 60%) were novel to this cohort including 92 in KCNQ1, 159 in KCNH2, and 70 in SCN5A. The vast majority (76%) of the mutations were observed in a single index case while 134 mutations (24%) were observed more than once in this cohort. The five most commonly observed LQTS-causing mutations were L266P-KCNQ1 seen in 30 unrelated patients, R518X-KCNQ1 in 24, R594Q-KCNQ1 in fifteen, G168R-KCNQ1 in fifteen, and E1784K-SCN5A in fifteen unrelated patients.

Overall, the majority of mutations (394/562, 70%) were missense, while 85 (15%) were frame-shift mutations, 33 (5.9%) involved canonical splice sites, 33 (5.9%) were nonsense mutations, and 17 (3%) were in-frame insertions/deletions. While 64% of all frame-shift mutations were identified in KCNH2 (representing 24% of all KCNH2 mutations), 76% of the splice-site mutations involved KCNQ1 (representing 12.5% of all KCNQ1 mutations). As will be discussed below, five nonsense (Q73X, R179X, R222X, Y389X, and W1798X) and two frame-shift mutations (V850fs+18X and L1786fs+45X) were identified in SCN5A.

For mutations in KCNQ1, 102/199 (51%) localized to the transmembrane spanning and pore-forming domains, thirteen (6.5%) to the specialized Subunit Assembly Region, 15 (7.5%) in the N-terminus, and 69 (35%) resided in the C-terminus (Table 1). For mutations in KCNH2, 73/226 (32%) localized to the transmembrane spanning and pore-forming domains, 18 (8%) in the N-terminal PAS/PAC regulatory domains, 47 (21%) elsewhere in the N-terminus, 18 (8%) in the C-terminal cyclic nucleotide domain (cNBD), and 70 (31%) elsewhere in the C-terminus (Table 2). Among the 108 mutations in SCN5A, eleven (10%) localized to the N-terminus, 46 (43%) to the transmembrane spanning and pore-forming domains, 38 (35%) to the inter-domain cytoplasmic linkers (DI-DII, DII-DIII, and DIII-DIV), and thirteen (12%) to the C-terminus (Table 3).

TABLE 1

Summary of putative LQT1-associated mutations in KCNQ1

| Region | Nucleotide | Variant | Position in SEQ ID NO: 1 | Mutation Type | Location | No. of patients |
|--------|-----------|---------|--------------------------|---------------|----------|-----------------|
| Exon 1 | 5 C > T | A2V* | 80533 | Missense | N-Terminal | 1 |
| Exon 1 | 19 C > T | P7S* | 80547 | Missense | N-Terminal | 1 |
| Exon 1 | 108insT | F36fs + 247X* | 80636 | Frame shift | N-Terminal | 1 |
| Exon 1 | 136 G > A | A46T | 80664 | Missense | N-Terminal | 2 |
| Exon 1 | 153 C > G | Y51X | 80681 | Nonsense | N-Terminal | 1 |
| Exon 1 | 176delC | A58fs + 26X* | 80704 | Frame shift | N-Terminal | 1 |

TABLE 1-continued

Summary of putative LQT1-associated mutations in KCNQ1

| Region | Nucleotide | Variant | Position in SEQ ID NO: 1 | Mutation Type | Location | No. of patients |
|---|---|---|---|---|---|---|
| Exon 1 | 190_210del | 64_70del | Del: 80718 to 80738 | In-frame del | N-Terminal | 3 |
| Exon 1 | 197 C > T | S66F* | 80725 | Missense | N-Terminal | 1 |
| Exon 1 | 200_210del | S66fs + 213X* | Del: 80728 to 80738 | Frame shift | N-Terminal | 1 |
| Exon 1 | 217 C > A | P73T | 80745 | Missense | N-Terminal | 4 |
| Exon 1 | 242_264del; insGCGCC CGCGG (SEQ ID NO: 6) | G80fs + 151X* | Del: 80770 to 80792 Ins: SEQ ID NO: 6 | Frame shift | N-Terminal | 1 |
| Exon 1 | 273_299del; insGG | V91fs + 136X* | Del: 80801 to 80827 Ins: GG | Frame shift | N-Terminal | 1 |
| Exon 1 | 332 A > G | Y111C | 80860 | Missense | N-Terminal | 5 |
| Exon 1 | 350 C > T | P117L | 80878 | Missense | N-Terminal | 1 |
| Exon 1 | 365insT | K121fs + 162X* | 80893 | Frame shift | N-Terminal | 2 |
| Exon 1 | 381 C > A | F127L* | 80909 | Missense | S1 Domain | 1 |
| Intron 1 | 386 + 1 G > A | | 80915 | Splice site | S1 Domain | 1 |
| Exon 2 | 397 G > A | V133I | 163375 | Missense | S1 Domain | 1 |
| Exon 2 | 401 T > C | L134P* | 163379 | Missense | S1 Domain | 1 |
| Exon 2 | 403delG | L134fs + 101X* | 163381 | Frame shift | S1 Domain | 1 |
| Exon 2 | 430 A > G | T144A | 163408 | Missense | S1/S2 | 1 |
| Exon 2 | 451_452delCT | A150fs + 132X | 163429 | Frame shift | S2 Domain | 1 |
| Exon 2 | 458 C > T | T153M* | 163436 | Missense | S2 Domain | 1 |
| Intron 2 | 477 + 1 G > A | | 163456 | Splice site | S2 Domain | 1 |
| Intron 2 | 477 + 5 G > C | | 163460 | Splice site | S2 Domain | 1 |
| Intron 2 | 477 + 5 G > A | | 163460 | Splice site | S2 Domain | 4 |
| Exon 3 | 479 A > T | E160V* | 206043 | Missense/Splice | S2 Domain | 1 |
| Exon 3 | 484 G > A | V162M* | 206048 | Missense | S2 Domain | 1 |
| Exon 3 | 488delT | V162fs + 73X | 206052 | Frame shift | S2 Domain | 1 |
| Exon 3 | 502 G > A | G168R | 206066 | Missense | S2 Domain | 15 |
| Exon 3 | 502 G > C | G168R | 206066 | Missense | S2 Domain | 4 |
| Exon 3 | 504delG | G168fs + 67X* | 206068 | Frame shift | S2 Domain | 1 |
| Exon 3 | 513 C > G | Y171X | 206077 | Nonsense | S2/S3 | 1 |
| Exon 3 | 514 G > A | V172M | 206078 | Missense | S2/S3 | 2 |
| Exon 3 | 520 C > T | R174C | 206084 | Missense | S2/S3 | 1 |
| Exon 3 | 521 G > A | R174H | 206085 | Missense | S2/S3 | 1 |
| Exon 3 | 524_534del | R174fs + 105X* | Del: 206088 to 206098 | Frame shift | S2/S3 | 1 |
| Exon 3 | 532 G > A | A178T | 206096 | Missense | S2/S3 | 1 |
| Exon 3 | 535 G > A | G179S | 206099 | Missense | S2/S3 | 2 |
| Exon 3 | 550 T > C | Y184H* | 206114 | Missense | S2/S3 | 1 |
| Exon 3 | 556 G > C | G186R* | 206120 | Missense | S2/S3 | 1 |
| Exon 3 | 564 G > A | W188X* | 206128 | Nonsense | S2/S3 | 1 |
| Exon 3 | 569 G > A | R190Q | 206133 | Missense | S2/S3 | 3 |
| Exon 3 | 569 G > T | R190L* | 206133 | Missense | S2/S3 | 1 |
| Exon 3 | 573_577delGCGCT | L191fs + 90X | 206137 | Frame shift | S2/S3 | 4 |
| Exon 3 | 583 C > T | R195W* | 206147 | Missense | S2/S3 | 2 |
| Exon 3 | 585delG | R195fs + 40X | 206149 | Frame shift | S2/S3 | 4 |
| Exon 3 | 592 A > G | I198V* | 206156 | Missense | S3 Domain | 1 |
| Exon 3 | 595 T > G | S199A* | 206159 | Missense | S3 Domain | 1 |
| Exon 3 | 604 G > A | D202N | 206168 | Missense/Splice | S3 Domain | 1 |
| Intron 3 | 605 − 2 A > G | | 206737 | Splice site | S3 Domain | 1 |
| Exon 4 | 612 C > G | I204M | 206746 | Missense | S3 Domain | 1 |
| Exon 4 | 643 G > A | V215M | 206777 | Missense | S3 Domain | 1 |
| Exon 4 | 671 C > T | T224M* | 206805 | Missense | S3/S4 | 1 |
| Exon 4 | 674 C > T | S225L | 206808 | Missense | S3/S4 | 8 |
| Exon 5 | 691 C > T | R231C | 207434 | Missense | S4 Domain | 1 |
| Exon 5 | 692 G > A | R231H | 207435 | Missense | S4 Domain | 1 |
| Exon 5 | 704 T > A | I235N | 207447 | Missense | S4 Domain | 2 |
| Exon 5 | 722 T > G | V241G* | 207465 | Missense | S4 Domain | 1 |
| Exon 5 | 724 G > A | D242N | 207467 | Missense | S4 Domain | 4 |
| Exon 5 | 727delC | D242fs + 19X* | 207470 | Frame shift | S4 Domain | 1 |
| Exon 5 | 727 C > T | R243C | 207470 | Missense | S4 Domain | 1 |
| Exon 5 | 749 T > C | L250P* | 207492 | Missense | S4/S5 | 1 |
| Exon 5 | 760 G > A | V254M | 207503 | Missense | S4/S5 | 10 |
| Exon 5 | 775 C > T | R259C | 207518 | Missense | S4/S5 | 5 |
| Exon 5 | 776_780dupCCACC | H258fs + 5X* | 207519 | Frame shift | S4/S5 | 1 |
| Exon 5 | 776 G > T | R259L | 207519 | Missense | S4/S5 | 1 |
| Exon 6 | 781 G > C | E261Q* | 208260 | Missense/Splice | S4/S5 | 1 |
| Exon 6 | 781 G > T | E261X* | 208260 | Nonsense/Splice | S4/S5 | 1 |
| Exon 6 | 784 C > G | L262V | 208263 | Missense | S5 domain | 1 |
| Exon 6 | 796delC | T265fs + 22X | 208275 | Frame shift | S5 domain | 3 |
| Exon 6 | 797 T > C | L266P | 208276 | Missense | S5 domain | 30 |

TABLE 1-continued

Summary of putative LQT1-associated mutations in KCNQ1

| Region | Nucleotide | Variant | Position in SEQ ID NO: 1 | Mutation Type | Location | No. of patients |
|---|---|---|---|---|---|---|
| Exon 6 | 803 T > G | I268S* | 208282 | Missense | S5 domain | 1 |
| Exon 6 | 805 G > A | G269S | 208284 | Missense | S5 domain | 10 |
| Exon 6 | 806 G > A | G269D | 208285 | Missense | S5 domain | 4 |
| Exon 6 | 815 G > A | G272D | 208294 | Missense | S5 domain | 1 |
| Exon 6 | 817 C > T | L273F | 208296 | Missense | S5 domain | 7 |
| Exon 6 | 820 A > G | I274V | 208299 | Missense | S5 domain | 1 |
| Exon 6 | 829 T > C | S277P* | 208308 | Missense | S5 domain | 1 |
| Exon 6 | 830 C > T | S277L | 208309 | Missense | S5 domain | 2 |
| Exon 6 | 839 T > A | V280E | 208318 | Missense | S5 domain | 1 |
| Exon 6 | 842 A > G | Y281C | 208321 | Missense | S5 domain | 1 |
| Exon 6 | 845 T > C | L282P | 208324 | Missense | S5 domain | 1 |
| Exon 6 | 848 C > G | A283G* | 208327 | Missense | S5/pore | 2 |
| Exon 6 | 862_880del | A287fs + 59X* | Del: 208341 to 208359 | Frame shift | S5/pore | 2 |
| Exon 6 | 875 G > A | G292D | 208354 | Missense | S5/pore | 1 |
| Exon 6 | 877 C > T | R293C | 208356 | Missense | S5/pore | 4 |
| Exon 6 | 905 C > T | A302V | 208384 | Missense | Pore | 1 |
| Exon 6 | 905 C > A | A302E* | 208384 | Missense | Pore | 1 |
| Exon 6 | 908 T > C | L303P* | 208387 | Missense | Pore | 1 |
| Exon 6 | 913 T > C | W305R* | 208392 | Missense | Pore | 1 |
| Exon 6 | 914 G > C | W305S | 208393 | Missense | Pore | 1 |
| Exon 6 | 914 G > A | W305X | 208393 | Nonsense | Pore | 1 |
| Exon 6 | 916 G > A | G306R | 208395 | Missense | Pore | 1 |
| Exon 6 | 916 G > C | G306R | 208395 | Missense | Pore | 1 |
| Exon 7 | 935 C > T | T312I | 218864 | Missense | Pore | 2 |
| Exon 7 | 940 G > A | G314S | 218869 | Missense | Pore | 7 |
| Exon 7 | 940 G > T | G314C | 218869 | Missense | Pore | 1 |
| Exon 7 | 944 A > G | Y315C | 218873 | Missense | Pore | 4 |
| Exon 7 | 947 G > T | G316V* | 218876 | Missense | Pore | 1 |
| Exon 7 | 958 C > T | P320S* | 218887 | Missense | Pore | 1 |
| Exon 7 | 964 A > G | T322A | 218893 | Missense | Pore/S6 | 2 |
| Exon 7 | 965 C > T | T322M | 218894 | Missense | Pore/S6 | 4 |
| Exon 7 | 973 G > A | G325R | 218902 | Missense | Pore/S6 | 6 |
| Exon 7 | 1016 T > A | F339Y* | 218945 | Missense | S6 | 1 |
| Exon 7 | 1017_1019delCTT | 340delF | 218946 | In-frame del | S6 | 1 |
| Exon 7 | 1022 C > A | A341E | 218951 | Missense | S6 | 4 |
| Exon 7 | 1022 C > T | A341V | 218951 | Missense | S6 | 8 |
| Exon 7 | 1022 C > G | A341G* | 218951 | Missense | S6 | 1 |
| Exon 7 | 1024 C > T | L342F | 218953 | Missense | S6 | 2 |
| Exon 7 | 1028 C > T | P343L | 218957 | Missense | S6 | 1 |
| Exon 7 | 1031 C > T | A344V | 218960 | Missense/Splice | S6 | 1 |
| Exon 7 | 1032 G > A | A344A | 218961 | Silent/Splice | S6 | 10 |
| Intron 7 | 1032 + 1 G > T | | 218962 | Splice site | S6 | 1 |
| Intron 7 | 1032 + 1 G > A | | 218962 | Splice site | S6 | 2 |
| Intron 7 | 1032 + 2 T > C | | 218963 | Splice site | S6 | 1 |
| Intron 7 | 1032 + 5 G > T | | 218966 | Splice site | S6 | 1 |
| Exon 8 | 1046 C > A | S349X | 220642 | Nonsense | C-Terminal | 1 |
| Exon 8 | 1048 G > A | G350R | 220644 | Missense | C-Terminal | 1 |
| Exon 8 | 1052 T > C | F351S | 220648 | Missense | C-Terminal | 1 |
| Exon 8 | 1061 A > G | K354R* | 220657 | Missense | C-Terminal | 1 |
| Exon 8 | 1066 C > T | Q356X | 220662 | Nonsense | C-Terminal | 1 |
| Exon 8 | 1075 C > T | Q359X* | 220671 | Nonsense | C-Terminal | 4 |
| Exon 8 | 1079 G > T | R360M* | 220675 | Missense | C-Terminal | 2 |
| Exon 8 | 1085 A > G | K362R | 220681 | Missense | C-Terminal | 5 |
| Exon 8 | 1093 A > C | N365H* | 220689 | Missense | C-Terminal | 1 |
| Exon 8 | 1096 C > T | R366W | 220692 | Missense | C-Terminal | 8 |
| Exon 8 | 1097 G > A | R366Q | 220693 | Missense | C-Terminal | 1 |
| Exon 8 | 1121 T > A | L374H | 220717 | Missense | C-Terminal | 1 |
| Intron 8 | 1128 + 1 G > A | | 220725 | Splice site | C-Terminal | 1 |
| Intron 8 | 1128 + 1 G > T | | 220725 | Splice site | C-Terminal | 1 |
| Intron 8 | 1128 + 5 G > A | | 220729 | Splice site | C-Terminal | 1 |
| Exon 9 | 1135 T > G | W379G* | 222994 | Missense | C-Terminal | 1 |
| Exon 9 | 1153 G > A | E385K* | 223012 | Missense | C-Terminal | 1 |
| Exon 9 | 1165 T > C | S389P* | 223024 | Missense | C-Terminal | 1 |
| Exon 9 | 1171_1173dupCTT | 391dupS* | 223030 | In-frame ins | C-Terminal | 1 |
| Exon 9 | 1177_1179dupTGG | 393dupW* | 223036 | In-frame ins | C-Terminal | 3 |
| Exon 9 | 1189 C > T | R397W | 223048 | Missense | C-Terminal | 3 |
| Exon 9 | 1193 A > G | K398R* | 223052 | Missense | C-Terminal | 1 |
| Exon 9 | 1196_1197delCCinsA | K398fs + 19X* | 223055 | Frame shift | C-Terminal | 1 |
| Exon 9 | 1202insC | P400fs + 61X | 223061 | Frame shift | C-Terminal | 1 |
| Intron 9 | 1251 + 2 T > C | | 223112 | Splice site | C-Terminal | 1 |
| Exon 10 | 1265delA | K421fs + 9X* | 224144 | Frame shift | C-Terminal | 2 |
| Exon 10 | 1338 C > G | D446E* | 224217 | Missense | C-Terminal | 2 |
| Exon 10 | 1343 C > T | P448L* | 224222 | Missense | C-Terminal | 1 |

TABLE 1-continued

Summary of putative LQT1-associated mutations in KCNQ1

| Region | Nucleotide | Variant | Position in SEQ ID NO: 1 | Mutation Type | Location | No. of patients |
|---|---|---|---|---|---|---|
| Exon 10 | 1351 C > T | R451W* | 224230 | Missense | C-Terminal | 1 |
| Exon 10 | 1378 G > A | G460S | 224257 | Missense | C-Terminal | 1 |
| Exon 11 | 1430 C > T | P477L* | 297413 | Missense | C-Terminal | 1 |
| Exon 11 | 1462delG | E487fs + 9X* | 297445 | Frame shift | C-Terminal | 1 |
| Exon 11 | 1486_1487delCT | T495fs + 18X | 297469 | Frame shift | C-Terminal | 1 |
| Exon 11 | 1513 C > T | Q505X* | 297496 | Nonsense/Splice | C-Terminal | 1 |
| Intron 11 | 1515 − 2 delAG | | 404258 | Splice site | C-Terminal | 1 |
| Exon 12 | 1531 C > T | R511W* | 404276 | Missense | C-Terminal | 1 |
| Exon 12 | 1552 C > T | R518X | 404297 | Nonsense | C-Terminal | 24 |
| Exon 12 | 1553 G > A | R518Q* | 404298 | Missense | C-Terminal | 1 |
| Exon 12 | 1559 T > G | M520R | 404304 | Missense | C-Terminal | 3 |
| Exon 12 | 1565 A > C | Y522S* | 404310 | Missense | C-Terminal | 1 |
| Exon 12 | 1571 T > G | V524G | 404316 | Missense | C-Terminal | 1 |
| Exon 12 | 1573 G > A | A525T | 404318 | Missense | C-Terminal | 1 |
| Exon 12 | 1574 C > T | A525V | 404319 | Missense | C-Terminal | 1 |
| Exon 12 | 1588 C > T | Q530X | 404333 | Nonsense | C-Terminal | 10 |
| Exon 13 | 1591 C > T | Q531X* | 411376 | Nonsense/Splice | C-Terminal | 1 |
| Exon 13 | 1597 C > T | R533W | 411382 | Missense | C-Terminal | 2 |
| Exon 13 | 1615 C > T | R539W | 411400 | Missense | C-Terminal | 6 |
| Exon 13 | 1616 G > A | R539Q* | 411401 | Missense | C-Terminal | 1 |
| Exon 13 | 1621 G > A | V541I* | 411406 | Missense | C-Terminal | 1 |
| Exon 13 | 1627 G > A | E543K* | 411412 | Missense | C-Terminal | 1 |
| Exon 13 | 1637 C > T | S546L | 411422 | Missense | C-Terminal | 4 |
| Exon 13 | 1640 A > G | Q547R* | 411425 | Missense | C-Terminal | 1 |
| Exon 13 | 1663 C > A | R555S* | 411448 | Missense | C-Terminal | 1 |
| Exon 13 | 1663 C > T | R555C | 411448 | Missense | C-Terminal | 4 |
| Exon 13 | 1664 G > A | R555H | 411449 | Missense | C-Terminal | 1 |
| Exon 13 | 1669 A > G | K557E | 411454 | Missense | C-Terminal | 1 |
| Intron 13 | 1686 − 1 G > T | | 412401 | Splice site | C-Terminal | 1 |
| Exon 14 | 1696 T > C | S566P* | 412412 | Missense | C-Terminal | 1 |
| Exon 14 | 1697 C > T | S566F | 412413 | Missense | C-Terminal | 5 |
| Exon 14 | 1697 C > A | S566Y | 412413 | Missense | C-Terminal | 2 |
| Exon 14 | 1700 T > C | I567T | 412416 | Missense | C-Terminal | 3 |
| Exon 14 | 1702 G > A | G568R | 412418 | Missense | C-Terminal | 7 |
| Exon 14 | 1705 A > G | K569E* | 412421 | Missense | C-Terminal | 1 |
| Exon 14 | 1712 C > T | S571L* | 412428 | Missense | C-Terminal | 1 |
| Exon 15 | 1760 C > T | T587M | 413419 | Missense | C-Terminal | 2 |
| Exon 15 | 1766 G > A | G589D | 413425 | Missense | SAR | 1 |
| Exon 15 | 1771 C > T | R591C | 413430 | Missense | SAR | 1 |
| Exon 15 | 1772 G > A | R591H | 413431 | Missense | SAR | 7 |
| Exon 15 | 1781 G > A | R594Q | 413440 | Missense | SAR | 15 |
| Exon 15 | 1781 G > C | R594P | 413440 | Missense | SAR | 1 |
| Exon 15 | 1786_1788delAGA | 596delE* | 413447 | In-frame del | SAR | 1 |
| Exon 15 | 1786 G > A | E596K* | 413445 | Missense | SAR | 1 |
| Exon 15 | 1794 G > A | K598K* | 413453 | Silent/Splice | SAR | 2 |
| Intron 15 | 1794 + 1 G > T | | 413454 | Splice site | SAR | 1 |
| Exon 16 | 1799 C > T | T600M | 483187 | Missense | SAR | 3 |
| Exon 16 | 1811insC | D603fs + 47X* | 483199 | Frame shift | SAR | 1 |
| Exon 16 | 1831 G > A | D611N* | 483219 | Missense | SAR | 1 |
| Exon 16 | 1842_1844delCCA | 614delH* | 483230 | In-frame del | SAR | 1 |
| Exon 16 | 1876 G > A | G626S | 483264 | Missense | C-Terminal | 1 |
| Exon 16 | 1894insC | P631fs + 19X | 483282 | Frame shift | C-Terminal | 1 |
| Exon 16 | 1903 G > A | G635R* | 483291 | Missense | C-Terminal | 2 |
| Exon 16 | 1986 C > G | Y662X* | 483374 | Nonsense | C-Terminal | 1 |

*denotes a novel variant, unique to this cohort. Deletion variants are indicated as del, insertions as ins, duplications as dup, and frameshift mutations are annotated for example as R174fs + 105X format, where R174 represents the last properly encoded amino acid followed by a frameshift (fs) in the coding sequence resulting in 105 miscoded amino acids leading up to a premature stop codon (X). SAR = subunit assembly region.

TABLE 2

Summary of putative LQT2-associated mutations in KCNH2

| Region | Nucleotide | Variant | Position in SEQ ID NO: 2 | Mutation Type | Location | No. of patients |
|---|---|---|---|---|---|---|
| Exon 1 | 47 A > C | D16A* | 4060 | Missense | N-Terminal | 1 |
| Exon 1 | 58 C > G | R20G* | 4071 | Missense | N-Terminal | 1 |
| Exon 1 | 73delC | G24fs + 34X* | 4086 | Frame shift | N-Terminal | 1 |
| Exon 2 | 87 C > A | F29L | 6996 | Missense | N-Terminal | 1 |
| Exon 2 | 89 T > C | I30T* | 6998 | Missense | N-Terminal | 1 |

TABLE 2-continued

Summary of putative LQT2-associated mutations in KCNH2

| Region | Nucleotide | Variant | Position in SEQ ID NO: 2 | Mutation Type | Location | No. of patients |
|---|---|---|---|---|---|---|
| Exon 2 | 94 G > A | A32T* | 7003 | Missense | N-Terminal | 1 |
| Exon 2 | 100delG | N33fs + 25X* | 7009 | Frame shift | N-Terminal | 1 |
| Exon 2 | 121 G > T | V41F* | 7030 | Missense | PAS | 1 |
| Exon 2 | 133 A > T | N45Y* | 7042 | Missense | PAS | 1 |
| Exon 2 | 158 G > A | G53D* | 7067 | Missense | PAS | 1 |
| Exon 2 | 160 T > C | Y54H* | 7069 | Missense | PAS | 1 |
| Exon 2 | 169 G > C | A57P* | 7078 | Missense | PAS | 1 |
| Exon 2 | 192 C > G | C64W* | 7101 | Missense | PAS | 1 |
| Exon 2 | 208 C > A | H70N* | 7117 | Missense | PAS | 1 |
| Exon 2 | 209 A > G | H70R | 7118 | Missense | PAS | 4 |
| Exon 2 | 215_239del; insGGCCCGT | 72_80del; insRPV* | Del: 7124 to 7148 | In-frame indel | N-Terminal | 1 |
| Exon 2 | 215 C > T | P72L* | 7124 | Missense | N-Terminal | 1 |
| Exon 2 | 215 C > A | P72Q | 7124 | Missense | N-Terminal | 10 |
| Exon 2 | 219_226delCACGCAGCinsT | R73fs + 39X* | 7128 | Frame shift | N-Terminal | 1 |
| Exon 2 | 220 A > C | T74P* | 7129 | Missense | N-Terminal | 1 |
| Exon 2 | 221 C > G | T74R* | 7130 | Missense | N-Terminal | 1 |
| Exon 2 | 221 C > T | T74M | 7130 | Missense | N-Terminal | 1 |
| Exon 2 | 234_241delTGCCGCGC | A78fs + 62X* | 7143 | Frame shift | N-Terminal | 2 |
| Exon 2 | 254 C > T | A85V | 7163 | Missense | N-Terminal | 1 |
| Exon 2 | 257 T > C | L86P* | 7166 | Missense | N-Terminal | 1 |
| Exon 2 | 281 T > G | V94G* | 7190 | Missense | PAC | 1 |
| Exon 2 | 298 C > T | R100W* | 7207 | Missense | PAC | 2 |
| Exon 2 | 299 G > A | R100Q | 7208 | Missense | PAC | 1 |
| Exon 2 | 305 A > C | D102A* | 7214 | Missense | PAC | 1 |
| Exon 3 | 317 T > A | F106Y* | 10326 | Missense | PAC | 1 |
| Exon 3 | 322 T > C | C108R* | 10331 | Missense | PAC | 1 |
| Exon 3 | 340 C > T | P114S | 10349 | Missense | PAC | 1 |
| Exon 3 | 374 T > G | F125C* | 10383 | Missense | PAC | 1 |
| Exon 3 | 376_387del | 126_129del | Del: 10385 to 10396 | In-frame del | PAC | 1 |
| Exon 3 | 422 C > T | P141L* | 10431 | Missense | PAC | 2 |
| Exon 3 | 446 G > C | G149A* | 10455 | Missense | N-Terminal | 1 |
| Exon 3 | 447insG | P151fs + 179X | 10456 | Frame shift | N-Terminal | 1 |
| Exon 3 | 454insC | P151fs + 179X | 10463 | Frame shift | N-Terminal | 1 |
| Intron 3 | 473 − 7 C > A | | 11544 | Splice site | N-Terminal | 1 |
| Exon 4 | 491 G > A | R164H* | 11569 | Missense | N-Terminal | 2 |
| Exon 4 | 506delC | P168fs + 4X* | 11584 | Frame shift | N-Terminal | 1 |
| Exon 4 | 545 C > A | S182X | 11623 | Nonsense | N-Terminal | 2 |
| Exon 4 | 548delG | S182fs + 17X* | 11626 | Frame shift | N-Terminal | 1 |
| Exon 4 | 569_586insGCGCGGGCGGCGCGGGCG (SEQ ID NO: 7) | 190_195 insGAG GAG* (SEQ ID NO: 8) | Ins: 11647 | In-frame ins | N-Terminal | 1 |
| Exon 4 | 640 G > T | E214X* | 11718 | Nonsense | N-Terminal | 1 |
| Exon 4 | 652 A > G | M218V* | 11730 | Missense | N-Terminal | 1 |
| Exon 4 | 685 G > T | E229X | 11763 | Nonsense | N-Terminal | 1 |
| Exon 4 | 724 C > G | R242G* | 11802 | Missense | N-Terminal | 1 |
| Exon 4 | 759_760delGC | A253fs + 76X* | 11837 | Frame shift | N-Terminal | 1 |
| Exon 4 | 775 G > A | D259N | 11853 | Missense | N-Terminal | 1 |
| Exon 4 | 830 C > A | A277D* | 11908 | Missense | N-Terminal | 1 |
| Exon 4 | 872 T > C | M291T* | 11950 | Missense | N-Terminal | 2 |
| Exon 4 | 902 G > T | R301L* | 11980 | Missense | N-Terminal | 1 |
| Exon 5 | 925delC | M308fs + 50X* | 12559 | Frame shift | N-Terminal | 2 |
| Exon 5 | 934 C > T | R312C | 12568 | Missense | N-Terminal | 1 |
| Exon 5 | 940 G > A | G314S* | 12574 | Missense | N-Terminal | 1 |
| Exon 5 | 967 G > A | D323N* | 12601 | Missense | N-Terminal | 1 |
| Exon 5 | 982 C > T | R328C | 12616 | Missense | N-Terminal | 4 |
| Exon 5 | 1006delA | Q335fs + 23X* | 12640 | Frame shift | N-Terminal | 1 |
| Exon 5 | 1096 C > T | R366X | 12730 | Nonsense | N-Terminal | 2 |
| Exon 5 | 1128 G > A | Q376Q | 12762 | Silent/Splice | N-Terminal | 3 |
| Exon 6 | 1138delC | S379fs + 53X* | 15872 | Frame shift | N-Terminal | 1 |
| Exon 6 | 1139delT | S379fs + 53X* | 15873 | Frame shift | N-Terminal | 1 |
| Exon 6 | 1193 G > A | W398X* | 15927 | Nonsense | N-Terminal | 1 |
| Exon 6 | 1205 A > G | H402R* | 15939 | Missense | N-Terminal | 1 |
| Exon 6 | 1262 C > T | T421M | 15996 | Missense | S1 Domain | 1 |
| Exon 6 | 1266delT | A422fs + 10X* | 16000 | Frame shift | S1 Domain | 1 |
| Exon 6 | 1280 A > G | Y427C* | 16014 | Missense | S1/S2 | 1 |
| Exon 6 | 1293 C > A | F431L* | 16027 | Missense | S1/S2 | 1 |
| Exon 6 | 1316delG | E438fs + 81X* | 16050 | Frame shift | S1/S2 | 1 |
| Exon 6 | 1319 C > T | P440L* | 16053 | Missense | S1/S2 | 1 |

TABLE 2-continued

Summary of putative LQT2-associated mutations in KCNH2

| Region | Nucleotide | Variant | Position in SEQ ID NO: 2 | Mutation Type | Location | No. of patients |
|---|---|---|---|---|---|---|
| Exon 6 | 1341 C > A | Y447X | 16075 | Nonsense | S1/S2 | 1 |
| Exon 6 | 1348 C > T | Q450X* | 16082 | Nonsense | S1/S2 | 1 |
| Exon 6 | 1352 C > T | P451L | 16086 | Missense | S2 Domain | 1 |
| Exon 6 | 1379delA | V459fs + 60X | 16113 | Frame shift | S2 Domain | 3 |
| Exon 6 | 1396 G > T | D466Y* | 16130 | Missense | S2 Domain | 1 |
| Exon 6 | 1418 C > A | T473N* | 16152 | Missense | S2/S3 | 1 |
| Exon 6 | 1419_1472 del; insA | T473fs + 26X* | Del: 16153 to 16206 | Frame shift | S2/S3 | 1 |
| Exon 6 | 1424 A > G | Y475C | 16158 | Missense | S2/S3 | 1 |
| Exon 6 | 1426 G > A | V476I* | 16160 | Missense | S2/S3 | 1 |
| Exon 6 | 1468 G > A | A490T | 16202 | Missense | S2/S3 | 1 |
| Exon 6 | 1478 A > G | Y493C | 16212 | Missense | S2/S3 | 2 |
| Exon 6 | 1478 A > C | Y493S* | 16212 | Missense | S2/S3 | 1 |
| Exon 6 | 1501 G > A | D501N | 16235 | Missense | S3 Domain | 2 |
| Intron 6 | 1557 + 1 G > C | | 16292 | Splice site | S3/S4 | 2 |
| Exon 7 | 1591 C > T | R531W* | 16914 | Missense | S4 Domain | 2 |
| Exon 7 | 1600 C > T | R534C | 16923 | Missense | S4 Domain | 4 |
| Exon 7 | 1601 G > T | R534L | 16924 | Missense | S4 Domain | 1 |
| Exon 7 | 1613_1619del AGCTGGA | R537fs + 24X | 16936 | Frame shift | S4 Domain | 1 |
| Exon 7 | 1655 T > C | L552S | 16978 | Missense | S5 domain | 2 |
| Exon 7 | 1673 C > A | A558E* | 16996 | Missense | S5 domain | 1 |
| Exon 7 | 1681 G > A | A561T | 17004 | Missense | S5 domain | 1 |
| Exon 7 | 1682 C > T | A561V | 17005 | Missense | S5 domain | 6 |
| Exon 7 | 1685 A > G | H562R* | 17008 | Missense | S5 domain | 2 |
| Exon 7 | 1688 G > A | W563X | 17011 | Nonsense | S5 domain | 1 |
| Exon 7 | 1693 G > A | A565T* | 17016 | Missense | S5 domain | 1 |
| Exon 7 | 1704 G > A | W568X* | 17027 | Nonsense | S5 domain | 1 |
| Exon 7 | 1714 G > A | G572S | 17037 | Missense | S5/Pore | 2 |
| Exon 7 | 1715 G > T | G572V* | 17038 | Missense | S5/Pore | 1 |
| Exon 7 | 1715 G > A | G572D | 17038 | Missense | S5/Pore | 1 |
| Exon 7 | 1742 C > A | S581X* | 17065 | Nonsense | S5/Pore | 1 |
| Exon 7 | 1744 C > T | R582C | 17067 | Missense | S5/Pore | 1 |
| Exon 7 | 1750 G > A | G584S | 17073 | Missense | S5/Pore | 4 |
| Exon 7 | 1750 G > C | G584R* | 17073 | Missense | S5/Pore | 1 |
| Exon 7 | 1755 G > T | W585C | 17078 | Missense | S5/Pore | 1 |
| Exon 7 | 1778 T > A | I593K* | 17101 | Missense | S5/Pore | 1 |
| Exon 7 | 1781 G > A | G594D* | 17104 | Missense | S5/Pore | 2 |
| Exon 7 | 1787 C > A | P596H* | 17110 | Missense | S5/Pore | 1 |
| Exon 7 | 1787 C > T | P596L | 17110 | Missense | S5/Pore | 1 |
| Exon 7 | 1790 A > G | Y597C | 17113 | Missense | S5/Pore | 1 |
| Exon 7 | 1797 C > A | S599R* | 17120 | Missense | S5/Pore | 1 |
| Exon 7 | 1801 G > T | G601C | 17124 | Missense | S5/Pore | 1 |
| Exon 7 | 1801 G > A | G601S | 17124 | Missense | S5/Pore | 2 |
| Exon 7 | 1810 G > A | G604S | 17133 | Missense | S5/Pore | 2 |
| Exon 7 | 1813 C > T | P605S* | 17136 | Missense | S5/Pore | 1 |
| Exon 7 | 1814 C > T | P605L* | 17137 | Missense | S5/Pore | 1 |
| Exon 7 | 1826 A > G | D609G | 17149 | Missense | S5/Pore | 1 |
| Exon 7 | 1838 C > T | T613M | 17161 | Missense | Pore | 7 |
| Exon 7 | 1841 C > T | A614V | 17164 | Missense | Pore | 6 |
| Exon 7 | 1847 A > G | Y616C* | 17170 | Missense | Pore | 1 |
| Exon 7 | 1877 G > A | G626D* | 17200 | Missense | Pore | 1 |
| Exon 7 | 1882 G > A | G628S | 17205 | Missense | Pore | 4 |
| Exon 7 | 1886 A > T | N629I* | 17209 | Missense | Pore | 2 |
| Exon 7 | 1886 A > G | N629S | 17209 | Missense | Pore | 1 |
| Exon 7 | 1901 C > T | T634I* | 17224 | Missense | Pore/S6 | 1 |
| Exon 7 | 1903 A > G | N635D* | 17226 | Missense | Pore/S6 | 1 |
| Exon 7 | 1905 C > G | N635K* | 17228 | Missense | Pore/S6 | 1 |
| Exon 7 | 1911 G > C | E637D | 17234 | Missense | Pore/S6 | 1 |
| Exon 7 | 1913_1915 delAGA | 638delK* | 17236 | In-frame del | Pore/S6 | 1 |
| Exon 7 | 1914 G > T | K638N* | 17237 | Missense | Pore/S6 | 1 |
| Exon 7 | 1930 G > C | V644L* | 17253 | Missense | S6 | 1 |
| Exon 7 | 1930 G > T | V644F | 17253 | Missense | S6 | 1 |
| Exon 7 | 1935 G > A | M645I* | 17258 | Missense | S6 | 1 |
| Exon 7 | 1942 G > A | G648S* | 17265 | Missense | S6 | 1 |
| Exon 8 | 1955delAT GCTAinsT | M651fs + 68X* | 17605 | Frame shift | S6 | 1 |
| Exon 8 | 1956delT | M651fs + X* | 17606 | Frame shift | S6 | 1 |
| Exon 8 | 1969 G > C | G657R* | 17619 | Missense | S6 | 1 |
| Exon 8 | 1969 G > A | G657S* | 17619 | Missense | S6 | 1 |
| Exon 8 | 1979 C > T | S660L | 17629 | Missense | C-Terminal | 3 |
| Exon 8 | 1985 T > C | I662T* | 17635 | Missense | C-Terminal | 1 |
| Exon 8 | 2033 T > C | L678P* | 17683 | Missense | C-Terminal | 1 |

TABLE 2-continued

Summary of putative LQT2-associated mutations in KCNH2

| Region | Nucleotide | Variant | Position in SEQ ID NO: 2 | Mutation Type | Location | No. of patients |
|---|---|---|---|---|---|---|
| Exon 8 | 2059 C > T | H687Y* | 17709 | Missense | C-Terminal | 1 |
| Exon 8 | 2078 T > C | L693P* | 17728 | Missense | C-Terminal | 1 |
| Exon 8 | 2131 A > G | I711V* | 17781 | Missense | C-Terminal | 1 |
| Exon 8 | 2145 G > A | A715A* | 17795 | Silent/Splice | C-Terminal | 3 |
| Intron 8 | 2146 − 2 A > G | | 18294 | Splice site | C-Terminal | 1 |
| Exon 9 | 2156delG | K718fs + 13X* | 18306 | Frame shift | C-Terminal | 1 |
| Exon 9 | 2182 A > T | I728F* | 18332 | Missense | C-Terminal | 2 |
| Exon 9 | 2230 C > T | R744X | 18380 | Nonsense | cNBD | 4 |
| Exon 9 | 2246 G > T | G749V* | 18396 | Missense | cNBD | 1 |
| Exon 9 | 2260_2270 dupGCCTTCGGGCC (SEQ ID NO: 9) | A753fs + 6X* | Dup. of 18399 to 18409 at 18410 | Frame shift | cNBD | 1 |
| Exon 9 | 2271 G > C | K757N* | 18421 | Missense | cNBD | 1 |
| Exon 9 | 2299 G > T | D767Y* | 18449 | Missense | cNBD | 1 |
| Exon 9 | 2309 T > C | V770A* | 18459 | Missense | cNBD | 1 |
| Exon 9 | 2320 G > T | D774Y | 18470 | Missense | cNBD | 1 |
| Exon 9 | 2362 G > A | E788K* | 18512 | Missense | cNBD | 1 |
| Exon 9 | 2371_2397del | 791_799del | Del: 18521 to 18547 | In-frame del | cNBD | 1 |
| Exon 9 | 2371 C > T | R791W | 18521 | Missense | cNBD | 1 |
| Intron 9 | 2398 + 1 G > T | | 18549 | Splice site | cNBD | 3 |
| Intron 9 | 2398 + 5 G > T | | 18553 | Splice site | cNBD | 4 |
| Exon 10 | 2417 G > A | G806E* | 19685 | Missense | cNBD | 1 |
| Exon 10 | 2419delG | G806fs + 2X* | 19687 | Frame shift | cNBD | 1 |
| Exon 10 | 2464 G > A | V822M | 19732 | Missense | cNBD | 1 |
| Exon 10 | 2467 C > T | R823W | 19735 | Missense | cNBD | 5 |
| Exon 10 | 2494 A > T | K832X* | 19762 | Nonsense | cNBD | 1 |
| Exon 10 | 2509 G > T | D837Y* | 19777 | Missense | cNBD | 1 |
| Exon 10 | 2536 C > T | P846S* | 19804 | Missense | C-Terminal | 1 |
| Exon 10 | 2587 C > T | R863X | 19855 | Nonsense | C-Terminal | 3 |
| Exon 11 | 2653 C > T | R885C | 20233 | Missense | C-Terminal | 1 |
| Exon 11 | 2660_2664 insCAAGC | K886fs + 88X* | 20240 | Frame shift | C-Terminal | 2 |
| Exon 11 | 2680 C > T | R894C* | 20260 | Missense | C-Terminal | 1 |
| Exon 11 | 2681_2685 dupCAGGC | R893fs + 81X* | 20261 | Frame shift | C-Terminal | 1 |
| Exon 11 | 2681 G > T | R894L* | 20261 | Missense | C-Terminal | 1 |
| Intron 11 | 2692 + 1_29 62 + 6insACACGG | | 20273 | Splice site | C-Terminal | 1 |
| Exon 12 | 2707 G > A | G903R* | 20852 | Missense | C-Terminal | 3 |
| Exon 12 | 2717 C > T | S906L* | 20862 | Missense | C-Terminal | 2 |
| | 2722_2725 dupGGCC | A907fs + 12X* | 20867 | Frame shift | C-Terminal | 1 |
| Exon 12 | 2729_2744del | G909fs + 58X* | Del: 20874 to 20889 | Frame shift | C-Terminal | 1 |
| Exon 12 | 2736_2751del | R912fs + 55X* | Del: 20881 to 20896 | Frame shift | C-Terminal | 1 |
| Exon 12 | 2738 C > T | A913V | 20883 | Missense | C-Terminal | 5 |
| Exon 12 | 2739dupCGGGC | G914fs + 60X* | 20884 | Frame shift | C-Terminal | 1 |
| Exon 12 | 2758 C > T | R920W* | 20903 | Missense | C-Terminal | 1 |
| Exon 12 | 2759 G > A | R920Q* | 20904 | Missense | C-Terminal | 1 |
| Exon 12 | 2765 G > A | R922Q* | 20910 | Missense | C-Terminal | 1 |
| Exon 12 | 2771 G > A | G924E* | 20916 | Missense | C-Terminal | 1 |
| Exon 12 | 2771 G > C | G924A* | 20916 | Missense | C-Terminal | 1 |
| Exon 12 | 2780 G > A | W927X | 20925 | Nonsense | C-Terminal | 1 |
| Exon 12 | 2784delG | G928fs + 44X* | 20930 | Frame shift | C-Terminal | 1 |
| Exon 12 | 2810 G > A | S937N* | 20955 | Missense | C-Terminal | 1 |
| Exon 12 | 2892delC | P964fs + 8X* | 21037 | Frame shift | C-Terminal | 1 |
| Exon 12 | 2893insC | P964fs + 153X* | 21038 | Frame shift | C-Terminal | 1 |
| Exon 12 | 2918_2920 insCC | P972fs + 1X* | 21063 | Frame shift | C-Terminal | 1 |
| Exon 12 | 2959_2960 delCT | P986fs + 130X | 21104 | Frame shift | C-Terminal | 1 |
| Exon 13 | 3002insT | F1000fs + 117X* | 21238 | Frame shift | C-Terminal | 1 |
| Exon 13 | 3002 G > A | W1001X | 21238 | Nonsense | C-Terminal | 5 |
| Exon 13 | 3014 G > A | R1005Q* | 21250 | Missense | C-Terminal | 1 |
| Exon 13 | 3020 G > A | R1007H* | 21256 | Missense | C-Terminal | 1 |
| Exon 13 | 3032delA | Q1010fs + 45X* | 21268 | Frame shift | C-Terminal | 1 |
| Exon 13 | 3040 C > T | R1014X | 21276 | Nonsense | C-Terminal | 1 |
| Exon 13 | 3088_3089 dupGC | S1029fs + 27X* | 21324 | Frame shift | C-Terminal | 1 |
| Exon 13 | 3093_3106del | R1033fs + 79X* | Del: 21329 to 21342 | Frame shift | C-Terminal | 1 |

TABLE 2-continued

Summary of putative LQT2-associated mutations in KCNH2

| Region | Nucleotide | Variant | Position in SEQ ID NO: 2 | Mutation Type | Location | No. of patients |
|---|---|---|---|---|---|---|
| Exon 13 | 3093dupGGGT | G1031fs + 87X* | 21330 | Frame shift | C-Terminal | 1 |
| Exon 13 | 3094delC | G1031fs + 24X | 21330 | Frame shift | C-Terminal | 1 |
| Exon 13 | 3097 C > T | R1033W* | 21333 | Missense | C-Terminal | 1 |
| Exon 13 | 3098insC | R1032fs + 85X* | 21334 | Frame shift | C-Terminal | 1 |
| Exon 13 | 3099_3112del | R1033fs + 79X* | Del: 21335 to 21348 | Frame shift | C-Terminal | 1 |
| Exon 13 | 3099delG | P1034fs + 21X | 21335 | Frame shift | C-Terminal | 1 |
| Exon 13 | 3099_3100 insCG | R1033fs + 23X* | 21335 | Frame shift | C-Terminal | 1 |
| Exon 13 | 3100_3107 delCCCCG GGGinsGGC | R1033fs + 82X* | 21336 | Frame shift | C-Terminal | 1 |
| Exon 13 | 3101_3108 delCCCGGGGC | R1033fs + 81X* | 21337 | Frame shift | C-Terminal | 1 |
| Exon 13 | 3101_3103 insGGC | 1034insR* | 21337 | In-frame ins | C-Terminal | 1 |
| Exon 13 | 3102_3111del | P1034fs + 18X* | Del: 21338 to 21347 | Frame shift | C-Terminal | 1 |
| Exon 13 | 3103delC | P1034fs + 21X | 21339 | Frame shift | C-Terminal | 2 |
| Exon 13 | 3104insC | P1034fs + 83X* | 21340 | Frame shift | C-Terminal | 2 |
| Exon 13 | 3108insG | G1036fs + 81X | 21344 | Frame shift | C-Terminal | 3 |
| Exon 13 | 3112 G > A | V1038M* | 21348 | Missense | C-Terminal | 1 |
| Exon 13 | 3113_3126 dupGCCCCG GGGCGACG (SEQ ID NO: 10) | D1037fs + 23X* | Dup. of 21335 to 21348 at 21349 | Frame shift | C-Terminal | 1 |
| Exon 13 | 3146 T > C | L1049P* | 21382 | Missense | C-Terminal | 1 |
| Exon 14 | 3196 C > G | L1066V* | 21705 | Missense | C-Terminal | 1 |
| Exon 14 | 3233 A > G | Y1078C* | 21742 | Missense | C-Terminal | 1 |
| Exon 14 | 3234delC | A1077fs + X* | 21743 | Frame shift | C-Terminal | 1 |
| Exon 14 | 3256insG | G1085fs + 32X* | 21765 | Frame shift | C-Terminal | 1 |
| Exon 14 | 3278 C > T | P1093L* | 21787 | Missense | C-Terminal | 2 |
| Exon 15 | 3343 A > G | M1115V* | 23214 | Missense | C-Terminal | 1 |
| Exon 15 | 3407_3410 dupCGCC | R1135fs + 134X* | 23278 | Frame shift | C-Terminal | 1 |
| Exon 15 | 3471insC | G1158fs + 110X* | 23342 | Frame shift | C-Terminal | 1 |

*denotes a novel variant, unique to this cohort. Deletion variants are indicated as "del", insertions as ins, duplications as "dup", and frameshift mutations are designated by "fs".

TABLE 3

Summary of putative LQT3-associated mutations in SCN5A

| Region | Nucleotide | Variant | Position in SEQ ID NO: 3 | Mutation Type | Location Type | No. of patients |
|---|---|---|---|---|---|---|
| Exon 2 | 53 G > A | R18Q* | 141435 | Missense | N-terminal | 1 |
| Exon 2 | 80 G > A | R27H | 141408 | Missense | N-terminal | 1 |
| Exon 2 | 89 A > G | E30G* | 141399 | Missense | N-terminal | 1 |
| Exon 2 | 128 G > A | R43Q | 141360 | Missense | N-terminal | 1 |
| Exon 2 | 142 G > A | E48K* | 141346 | Missense | N-terminal | 1 |
| Exon 2 | 154 C > T | P52S* | 141334 | Missense | N-terminal | 1 |
| Exon 2 | 158 G > A | R53Q* | 141330 | Missense | N-terminal | 1 |
| Exon 2 | 217 C > T | Q73X* | 141271 | Nonsense | N-terminal | 1 |
| Exon 3 | 310 C > G | R104Q* | 138573 | Missense | N-terminal | 1 |
| Exon 3 | 343 A > G | S115G* | 138540 | Missense | N-terminal | 1 |
| Exon 3 | 373 G > C | V125L | 138510 | Missense | N-terminal | 1 |
| Exon 5 | 535 C > T | R179X | 129099 | Nonsense | DI-S2/S3 | 1 |
| Exon 6 | 635 T > C | L212P | 121991 | Missense | DI-S3/S4 | 1 |
| Exon 6 | 664 C > T | R222X | 121962 | Nonsense | DI-S4 | 1 |
| Exon 6 | 665 G > A | R222Q* | 121961 | Missense | DI-S4 | 1 |
| Exon 6 | 673 C > T | R225W | 121953 | Missense | DI-S4 | 4 |
| Exon 7 | 718 G > A | V240M* | 118130 | Missense | DI-S4/S5 | 1 |
| Exon 7 | 739 G > C | V247L* | 118109 | Missense | DI-S4/S5 | 1 |
| Exon 7 | 825 C > A | N275K | 118023 | Missense | DI-S5 | 1 |
| Exon 7 | 865 G > A | G289S* | 117983 | Missense | DI-S5/S6 | 1 |
| Exon 9 | 1018 C > T | R340W* | 114971 | Missense | DI-S5/S6 | 1 |
| Exon 9 | 1099 C > T | R367C | 114890 | Missense | DI-S5/S6 | 2 |
| Exon 9 | 1109 C > T | T370M | 114880 | Missense | DI-S5/S6 | 1 |
| Exon 10 | 1167 C > A | Y389X* | 114302 | Nonsense | DI-S5/S6 | 1 |
| Exon 10 | 1190 T > C | I397T* | 114279 | Missense | DI-S6 | 1 |

TABLE 3-continued

Summary of putative LQT3-associated mutations in SCN5A

| Region | Nucleotide | Variant | Position in SEQ ID NO: 3 | Mutation Type | Location Type | No. of patients |
|---|---|---|---|---|---|---|
| Exon 10 | 1218 C > G | N406K | 114251 | Missense | DI-S6 | 1 |
| Exon 10 | 1225 C > G | L409V* | 114244 | Missense | DI-S6 | 1 |
| Exon 10 | 1231 G > A | V411M | 114238 | Missense | DI-S6 | 3 |
| Exon 10 | 1285_1287 delGAG | 429delE* | 114182 | In-frame del | DI/DII | 1 |
| Exon 11 | 1385 A > C | E462A* | 113042 | Missense | DI/DII | 1 |
| Exon 12 | 1588 T > G | F530V* | 112194 | Missense | DI/DII | 1 |
| Exon 12 | 1604 G > A | R535Q* | 112178 | Missense | DI/DII | 2 |
| Exon 12 | 1705 C > T | R569W* | 112077 | Missense | DI/DII | 1 |
| Exon 12 | 1712 G > T | S571I* | 112070 | Missense | DI/DII | 1 |
| Exon 12 | 1714 G > T | A572S* | 112068 | Missense | DI/DII | 2 |
| Exon 12 | 1715 C > T | A572V* | 112067 | Missense | DI/DII | 2 |
| Exon 12 | 1756_1761 delGCCCTC | 586_587delAL* | 112021 | In-frame del | DI/DII | 1 |
| Exon 12 | 1844 G > A | G615E | 111938 | Missense | DI/DII | 5 |
| Exon 13 | 1915 G > A | G639R | 107206 | Missense | DI/DII | 1 |
| Exon 13 | 1960 G > A | E654K* | 107161 | Missense | DI/DII | 1 |
| Exon 13 | 2018 T > C | L673P* | 107103 | Missense | DI/DII | 1 |
| Exon 14 | 2065 C > T | R689C* | 106106 | Missense | DI/DII | 1 |
| Exon 14 | 2102 C > T | P701L | 106069 | Missense | DI/DII | 1 |
| Exon 14 | 2192 C > T | T731I* | 105979 | Missense | DII-S1 | 1 |
| Exon 14 | 2249 A > G | Q750R* | 105922 | Missense | DII-S2 | 1 |
| Exon 15 | 2314 G > A | D772N | 95702 | Missense | DII-S2/S3 | 1 |
| Exon 16 | 2447 T > A | F816Y* | 94211 | Missense | DII-S4 | 1 |
| Exon 16 | 2542 A > T | I848F* | 94116 | Missense | DII-S5 | 1 |
| Exon 16 | 2552_2553 dupGT | V850fs + 18X* | 94107 | Frame shift | DII-S5 | 1 |
| Exon 17 | 2878 C > A | Q960K* | 89461 | Missense | DII/DIII | 1 |
| Exon 17 | 2894 G > T | R965L* | 89445 | Missense | DII/DIII | 1 |
| Exon 17 | 2942 G > T | C981F* | 89397 | Missense | DII/DIII | 1 |
| Exon 17 | 2989 G > T | A997S | 89350 | Missense | DII/DIII | 1 |
| Exon 17 | 3010 T > C | C1004R* | 89329 | Missense | DII/DIII | 1 |
| Exon 17 | 3157 G > A | E1053K | 89182 | Missense | DII/DIII | 1 |
| Exon 17 | 3206 C > T | T1069M | 89133 | Missense | DII/DIII | 1 |
| Exon 18 | 3299 C > T | A1100V* | 87605 | Missense | DII/DIII | 1 |
| Exon 18 | 3340 G > A | D1114N | 87564 | Missense | DII/DIII | 1 |
| Exon 19 | 3496 G > A | D1166N* | 84856 | Missense | DII/DIII | 1 |
| Exon 20 | 3596 A > C | Y1199S* | 83547 | Missense | DII/DIII | 1 |
| Exon 20 | 3634_3636 delATC | I212delI* | 83507 | In-frame del | DIII-S1 | 1 |
| Exon 22 | 3847 C > A | L1283M* | 70711 | Missense | DIII-S3 | 1 |
| Exon 22 | 3911 C > T | T1304M | 70647 | Missense | DIII-S4 | 3 |
| Exon 23 | 3974 A > G | N1325S | 68598 | Missense | DIII-S4/S5 | 3 |
| Exon 23 | 3976 G > T | A1326S* | 68596 | Missense | DIII-S4/S5 | 1 |
| Exon 23 | 4000 A > G | I1334V* | 68572 | Missense | DIII-S4/S5 | 1 |
| Exon 23 | 4012 C > G | L1338V* | 68560 | Missense | DIII-S5 | 1 |
| Exon 24 | 4296 G > C | R1432S | 65414 | Missense | DIII-S5/S6 | 1 |
| Exon 25 | 4415 A > G | N1472S* | 64643 | Missense | DIII/DIV | 1 |
| Exon 25 | 4418 T > G | F1473C | 64640 | Missense | DIII/DIV | 1 |
| Exon 26 | 4442 G > A | G1481E | 63936 | Missense | DIII/DIV | 1 |
| Exon 26 | 4459 A > C | M1487L* | 63919 | Missense | DIII/DIV | 1 |
| Exon 26 | 4463 C > G | T1488R* | 63915 | Missense | DIII/DIV | 1 |
| Exon 26 | 4467 G > T | E1489D* | 63911 | Missense | DIII/DIV | 1 |
| Exon 26 | 4478 A > G | K1493R | 63900 | Missense | DIII/DIV | 2 |
| Exon 26 | 4484 A > C | Y1495S* | 63894 | Missense | DIII/DIV | 1 |
| Exon 26 | 4492 A > G | M1498V* | 63886 | Missense | DIII/DIV | 1 |
| Exon 26 | 4501 C > G | L1501V | 63877 | Missense | DIII/DIV | 1 |
| Exon 26 | 4515 G > T | K1505N* | 63863 | Missense | DIII/DIV | 1 |
| Exon 26 | 4519_4527 delCAGAAGCCC | 1507_1509delQKP | 63851 | In-frame del | DIII/DIV | 1 |
| Exon 27 | 4594 G > A | V1532I* | 62678 | Missense | DIV-S1 | 1 |
| Exon 27 | 4680 G > C | L1560F* | 62592 | Missense | DIV-S2 | 1 |
| Exon 27 | 4779 C > G | I1593M* | 62493 | Missense | DIV-S3 | 1 |
| Exon 27 | 4781 T > C | F1594S* | 62491 | Missense | DIV-S3 | 1 |
| Exon 27 | 4786 T > A | F1596I* | 62486 | Missense | DIV-S3 | 2 |
| Exon 28 | 4850_4852 delTCT | 1617delF | 59700 | In-frame del | DIV-S3/S4 | 1 |
| Exon 28 | 4868 G > A | R1623Q | 59684 | Missense | DIV-S4 | 2 |
| Exon 28 | 4868 G > T | R1623L | 59684 | Missense | DIV-S4 | 1 |
| Exon 28 | 4877 G > A | R1626H | 59675 | Missense | DIV-S4 | 1 |
| Exon 28 | 4930 C > T | R1644C | 59622 | Missense | DIV-S4 | 1 |
| Exon 28 | 4948 C > T | L1650F* | 59604 | Missense | DIV-S4/S5 | 1 |
| Exon 28 | 4955 T > C | MT1652* | 59597 | Missense | DIV-S4/S5 | 1 |

TABLE 3-continued

Summary of putative LQT3-associated mutations in SCN5A

| Region | Nucleotide | Variant | Position in SEQ ID NO: 3 | Mutation Type | Location Type | No. of patients |
|---|---|---|---|---|---|---|
| Exon 28 | 5168 C > A | T1723N* | 59384 | Missense | DIV-S5/S6 | 1 |
| Exon 28 | 5215 C > T | R1739W* | 59337 | Missense | DIV-S5/S6 | 1 |
| Exon 28 | 5281 C > T | L1761F* | 59271 | Missense | DIV-S6 | 1 |
| Exon 28 | 5282 T > A | L1761H* | 59270 | Missense | DIV-S6 | 1 |
| Exon 28 | 5287 G > A | V1763M | 59265 | Missense | DIV-S6 | 1 |
| Exon 28 | 5329 G > A | V1777M | 59223 | Missense | C-Terminal | 1 |
| Exon 28 | 5336 C > T | T1779M | 59216 | Missense | C-Terminal | 2 |
| Exon 28 | 5350 G > A | E1784K | 59202 | Missense | C-Terminal | 15 |
| Exon 28 | 5361_5364 del TGAG | L1786fs + 45X* | 59188 | Frame shift | C-Terminal | 1 |
| Exon 28 | 5384 A > G | Y1795C | 59168 | Missense | C-Terminal | 1 |
| Exon 28 | 5393 G > A | W1798X* | 59159 | Nonsense | C-Terminal | 1 |
| Exon 28 | 5477 G > A | R1826H | 59075 | Missense | C-Terminal | 2 |
| Exon 28 | 5516 A > G | D1839G | 59036 | Missense | C-Terminal | 1 |
| Exon 28 | 5689 C > T | R1897W* | 58863 | Missense | C-Terminal | 1 |
| Exon 28 | 5701 G > C | E1901Q* | 58851 | Missense | C-Terminal | 1 |
| Exon 28 | 5929 T > A | Y1977N* | 58623 | Missense | C-Terminal | 1 |
| Exon 28 | 6010 T > G | F2004V* | 58542 | Missense | C-Terminal | 1 |
| Exon 28 | 6034 C > T | R2012C* | 58518 | Missense | C-Terminal | 1 |

*denotes a novel variant, unique to this cohort. Deletion variants are indicated as "del", duplications as "dup", and frameshift mutations are designated by "fs".

TABLE 4

Summary of putative LQT5-associated mutations in KCNE1

| Region | Nucleotide | Variant | Position in SEQ ID NO: 4 | Mutation Type | Location | No. of patients |
|---|---|---|---|---|---|---|
| Exon 4 | 9_12delGTCT | L3fs + 4X* | 13137 | Frame shift | N-Terminal | 1 |
| Exon 4 | 13insT | S4fs + 0X* | 13134 | Frame shift | N-Terminal | 1 |
| Exon 4 | 23 C > T | A8V | 13123 | Missense | N-Terminal | 1 |
| Exon 4 | 29 C > T | T10M | 13117 | Missense | N-Terminal | 3 |
| Exon 4 | 50 G > A | W17X* | 13096 | Nonsense | N-Terminal | 1 |
| Exon 4 | 83 C > T | S28L | 13063 | Missense | N-Terminal | 2 |
| Exon 4 | 95 G > A | R32H | 13051 | Missense | N-Terminal | 1 |
| Exon 4 | 163 G > A | G55S* | 12983 | Missense | Transmembrane | 1 |
| Exon 4 | 172 A > C | T58P | 12974 | Missense | Transmembrane | 2 |
| Exon 4 | 176 T > C | L59P | 12970 | Missense | Transmembrane | 2 |
| Exon 4 | 199 C > T | R67C* | 12947 | Missense | C-Terminal | 1 |
| Exon 4 | 200 G > A | R67H* | 12946 | Missense | C-Terminal | 1 |
| Exon 4 | 209 A > T | K70M* | 12937 | Missense | C-Terminal | 1 |
| Exon 4 | 226 G > A | D76N | 12920 | Missense | C-Terminal | 9 |
| Exon 4 | 227_229del ACCinsTCTA | N75fs + 34X* | 12917 | Frame shift | C-Terminal | 1 |
| Exon 4 | 247 G > A | E83K* | 12899 | Missense | C-Terminal | 1 |
| Exon 4 | 349 C > T | Q117X* | 12797 | Nonsense | C-Terminal | 1 |
| Exon 4 | 374 C > T | T125M | 12772 | Missense | C-Terminal | 1 |

*denotes a novel variant, unique to this cohort. Deletion variants are indicated as "del", insertion as "ins", and frameshift mutations are designated by "fs".

TABLE 5

Summary of putative LQT6-associated mutations in KCNE2

| Region | Nucleotide | Variant | Position SEQ ID NO: 5 | Mutation Type | Location | No. of patients |
|---|---|---|---|---|---|---|
| Exon 2 | 40 G > A | V14I | 15735 | Missense | N-Terminal | 1 |
| Exon 2 | 59 T > A | I20N* | 15754 | Missense | N-Terminal | 1 |
| Exon 2 | 80 G > A | R27H* | 15775 | Missense | N-Terminal | 1 |
| Exon 2 | 161 T > C | M54T | 15856 | Missense | Transmembrane | 3 |
| Exon 2 | 170 T > C | I57T | 15865 | Missense | Transmembrane | 2 |
| Exon 2 | 193 G > C | V65L* | 15888 | Missense | Transmembrane | 1 |
| Exon 2 | 230 G > A | R77Q | 15925 | Missense | C-Terminal | 2 |

TABLE 5-continued

Summary of putative LQT6-associated mutations in KCNE2

| Region | Nucleotide | Variant | Position SEQ ID NO: 5 | Mutation Type | Location | No. of patients |
|---|---|---|---|---|---|---|
| Exon 2 | 281 A > G | E94G* | 15976 | Missense | C-Terminal | 1 |
| Exon 2 | 369_370delCT | P123fs + 14X* | 16064 | Frame shift | C-Terminal | 1 |

*denotes a novel variant, unique to this cohort. Deletion variants are indicated as "del" and frameshift mutations are designated by "fs".

REFERENCES

1. Crotti, L., Celano, G., Dagradi, F., and Schwartz, P. J. 2008. Congenital long QT syndrome. *Orphanet J Rare Dis* 3:18.
2. Schwartz, P. J., et al. 2009. Prevalence of the congenital long-QT syndrome. *Circulation* 120:1761-1767.
3. Wang, Q., et al. 1996. Positional cloning of a novel potassium channel gene: KVLQT1 mutations cause cardiac arrhythmias. *Nat Genet* 12:17-23.
4. Abbott, G. W., et al. 1999. MiRP1 forms IKr potassium channels with HERG and is associated with cardiac arrhythmia. *Cell* 97:175-187.
5. Mohler, P. J., et al. 2003. Ankyrin-B mutation causes type 4 long-QT cardiac arrhythmia and sudden cardiac death. *Nature* 421:634-639.
6. Splawski, I., Tristani-Firouzi, M., Lehmann, M. H., Sanguinetti, M. C., and Keating, M. T. 1997. Mutations in the hminK gene cause long QT syndrome and suppress IKs function. *Nat Genet* 17:338-340.
7. Wang, Q., et al. 1995. SCN5A mutations associated with an inherited cardiac arrhythmia, long QT syndrome. *Cell* 80:805-811.
8. Chen, L., et al. 2007. Mutation of an A-kinase-anchoring protein causes long-QT syndrome. *Proc Natl Acad Sci USA* 104:20990-20995.
9. Medeiros-Domingo, A., et al. 2007. SCN4B-encoded sodium channel beta4 subunit in congenital long-QT syndrome. *Circulation* 116:134-142.
10. Plaster, N. M., et al. 2001. Mutations in Kir2.1 cause the developmental and episodic electrical phenotypes of Andersen's syndrome. *Cell* 105:511-519.
11. Splawski, I., et al. 2004. Ca(V)1.2 calcium channel dysfunction causes a multisystem disorder including arrhythmia and autism. *Cell* 119:19-31.
12. Ueda, K., et al. 2008. Syntrophin mutation associated with long QT syndrome through activation of the nNOS-SCN5A macromolecular complex. *Proc Natl Acad Sci USA* 105:9355-9360.
13. Vatta, M., et al. 2006. Mutant caveolin-3 induces persistent late sodium current and is associated with long-QT syndrome. *Circulation* 114:2104-2112.
14. Curran, M. E., et al. 1995. A molecular basis for cardiac arrhythmia: HERG mutations cause long QT syndrome. *Cell* 80:795-803.
15. Tester, D. J., Will, M. L., Haglund, C. M., and Ackerman, M. J. 2005. Compendium of cardiac channel mutations in 541 consecutive unrelated patients referred for long QT syndrome genetic testing. *Heart Rhythm* 2:507-517.
16. Kapplinger, J. D., et al. 2009. Spectrum and prevalence of mutations from the first 2,500 consecutive unrelated patients referred for the FAMILION long QT syndrome genetic test. *Heart Rhythm* 6:1297-1303.
17. Tester, D. J., et al. 2006. Allelic dropout in long QT syndrome genetic testing: a possible mechanism underlying false-negative results. *Heart Rhythm* 3:815-821.
18. Kapa, S., et al. 2009. Genetic testing for long-QT syndrome: distinguishing pathogenic mutations from benign variants. *Circulation* 120:1752-1760.
19. Moss, A. J., et al. 2007. Clinical aspects of type-1 long-QT syndrome by location, coding type, and biophysical function of mutations involving the KCNQ1 gene. *Circulation* 115:2481-2489.
20. Moss, A. J., et al. 2002. Increased risk of arrhythmic events in long-QT syndrome with mutations in the pore region of the human ether-a-go-go-related gene potassium channel. *Circulation* 105:794-799.
21. Shimizu, W., et al. 2009. Genotype-phenotype aspects of type 2 long QT syndrome. *J Am Coll Cardiol* 54:2052-2062.

EQUIVALENTS

Those skilled in the art will recognize, or be able to ascertain using no more than routine experimentation, many equivalents to the specific embodiments of the invention described herein. Such equivalents are intended to be encompassed by the following claims. The contents of all references, patents and published patent applications cited throughout this application are incorporated herein by reference.

SEQUENCE LISTING (10 sequences)

SEQ ID NO: 1 - DNA, 581288 bp, Homo sapiens
  misc_feature: KCNQ1 gene
agccgggcatggtggcatgtgcctgcagtcccagctaccggggtggctgaggcaggagacttgcttgaacccgggaggtggaggttgcagtgagccgagatcacgccattacacttcagccagggtgacagagtgaaactccgtctcaaaaaaaaaaaaaaaaagaaaaagaaaaggaaaaagaaatgaggacccaagggaagagggaaacccgtgtatttttatgtggagtttgatggagagtcatgcagagtgtgattggattagacaaagtgggtgtactcgtccgttcttgcactgtataaagaatacttgagactgcgtaattcataaagaaaggaggtttacttggcttacagttccccaggctgtacagaaagcatggtgctggcatccacatggcttctgggggcgggctcaggaaacttacaatcatggcggaaggcaaaggaggagctggcacttcacgtggccggagcaggaggaagcccagagggagagaggggaggtgccatatgcctttaaacaagcaggtctcatgagaactcactatcacgagaacagcactggggggaaatccacccccatgagccaatcacctccagcaggccccacctccagcattggggattacaattcaacatgagatttaggcaggtacacagatccaaaccgtatcagggtgtggcctaatggtgatacactggggagacttggcctgtggtcttagtccatcgtgtgctgttagaacagaaaaccacagactggctaacttattggcccctggtcctagaggctgggaggtccgagatcgacaggccacctctggcaagggtctttgtgctgccttatcccatgacagaagggcaaagagagggagagagagacagccagagagaaggggaccaaactcatccttctgtcagagcccgctcccacgacaatgatgttagtccatcatgattacagagatgggggacacattcagaccacagcagccccctcaacccgcacacactgcacattgaggggagggccgggagactggaaggaaacatcagagtctggagaagaccaccaggatcaccagggctatgctctcacccggcacccagcaccgaggggctcatgggaaacaagacgggtctctcggtgcacgagtgctgggcacacatagtccaccgtgcatcctgggctgatgatctggaccctggtcctgtgcagccctggggtggggctccaggctgagatcagccacgtctgggggaggagacagtgttcccagtctcaccttgccccacggactctgacaggggttgaagaagcaaggaggctccaaggactggggagggggagtctggccgacgatctaggagcatcaaggcgcctgctccctctcggcgtggcccggtcctgtaggtggtcagttatgcaatgccactgccttcctacctcacaaggagggtgggtggactcagaagccaggcccaggcttccttcttggctcaggcaaggaacatagggggctttgagctttgcttattcatttaacaactgaacccctagtctgtgccaggcccccatttaaatggtccctgggatacagcagggtccagaatgggcccagaccctgcccccatagctgaccttctggagagcctgaggagtgaggggtgccctccaggcacggcagacggggcaggctctgcattcgggggctccagctgctttcccaccacccacccactccacccgagcccttctgggtcagctgggctcctggctctgcccgcctggggtgcaagacgccaagttccttcctggacagtgagagaaccatgccaaaaagaaatgaaaggaaggcagacggcgagatgagggagagggtgggcacccagccagggaccgcagagacgaggaggaggcacagagacccactgtccccagccactgccagtgaggctggcccagggccaggggctgggcgtccctggcatgcatgtggctcccagtgcccccacgtccaacaggagtggggcggccccctcttctgccacatccccatcccacctcccattccattcactggtctcatttttaagtttttctctcccagttattcaggattgatttggagagcagagcgatggctgcaggtggctcttcattttccttcacctaagaagcaaaccatcatccaccccaagcttgtctctccagcctgccccctacatgaggacaacctccctcctcttccacggtggcgctgttcccactggaggcccaggcttggccatccgttcattcttggagtcctcaagagattgtcagctctgcagtggggagcagccgctgtcaaagaccctggaacttcctccctgctgcgtccaccaacccccactgcccgctgggcactcccaacctgaaacaagcttgctcgctgcaaaagcctcacctctgacccaacttcccactcccaggatacccaacctggccttccctctggatacccctgtgggctcccctctgctgatgggttcccctctccagctgtggcttccctctgctgatggggtcccctctccagctggggctccctccactgatggggttccctctacagctgtggctctctccactgatggggtcccctctccagctggggctccctccactgatgtggtcccctcttcagcttgggctccctccactgatggggtcccctcttcagctggggctcctctccactgacagggtctcctttccatctggggctcccttggctgatgaagtcccttctccaggtgaggctgctctctgctgacagggtcccctctccagctaggtctcctctctgttgatagggtcccctctccgggtgggctcccctctgctgacggggtcctctgatggggtccctactccaggggggctcccctccatagatgagctccccttcctgggttgggtgacccctccgccctatctgtgtctgcaggttggggctaggcagtgctggccagcatctgacaacctcccctttctgttcttgggcactgctcacttattcaggtctcagccaggcagcccctccaatggtaatcttcagagtccccttcagcaacacagcttcccctctgtggcccagctcatgctgaagtaaacaaggcaatgtcattaacggctggtatcagcttgtacggggaaccagtggccccagaagcctctggggaggcccaggctgtgaggatcaggggtccggaagagcctctagagcgggagaaagaggcctcaggggtccctcctcacaggggatggtgacaacacggtagggaatggaggggtcagggctgggtccaggacacggtgaccctggccagaaaaggccgggcctggctggcacccgcacgaagggaacggagccagtgtggaaaagcaggcccgcgtcctcttctgcactcccagcccctttaaactacacacagcttgtaggaaggggatcagaggcccctgggcgtcccatggctatgctgcacctggggacatgaagcctagggtagctcagccagctctggtcacggctgacagacagcctcaccccaacagcctcacccatccctcctcagggaacagggtcctaacaagctgctttccccatcccagtgttgaacaaaaactcatgggtttagacaagagtgaaggtgactcctccaccacccatcccacctccagcaggcagccacccccaaaattattgatttattaataaatcaatgacaggtgccagccagccccacctgtccccaacctgcaaatgcagacaggggtcacttggtccagggagaggagaccctcagtggaggggagacaccctggagaggggaccccatcagcaaaggggagccccagctggagacagtaaataggcagactattcactgtcttccccctcaagccaggcccacagagtcacagagtatagccaccagcctcctgggcccacccgggaggccccaaccacactccccctgctcagctcagcccggatttctggattctgctgcctgccagggatcctgaggaggagatggtatcagagcctcaccagcccttctcatacccaggagtcctcatgatgataacagtgtgtgcgccaggctgtgcaggtgctggccgggatcctctgaggggacgagatctccatgggagggcaccactctgatgtccatcctgggcttccgtggccctgcctggccactgcccgctgctcttggtcaagatcatggaccctcagaggccaaccaggcctcagcctgtgcctacagcatcctctctactgccgggcttctgaattgctccttcctcctgtctcccacccagagcaagaacgaaggggaggcccccagagccctgcagcgccgggagagactcccatccccaccccgcatgccatcaacacaaactgccggagagtttaggggatcccacgacttggggtctccaaagagacccccgggacatctcatcgagacccccctgggcactgcatgctcaggcttcccacccctggcccaccccatggggtgtgcccagtcccgcatctcaccccatatccatgcatgcatgcatgaacctgaaagcaccccacaccctctggtgctcagtcctcccctcctccctggggtcccctcccctccctgccccccaagccttgcatccccctgcaaacctcacaagggggaactatttctgtcctgaaagcagagagggcccttttcttgggacctctccgccatctctgcctccactcccagctgctgtcagctctggcctggcccctgcaggaagcaatcactggtctccctgtttcccatctggccccaaggtctgttcttgcccttcgaccagagaggtttgaaagcacaactcgggccctgcgtgccctgctccccagggctccacacctctgagcacccgcgcagtaacggaggctcccagccccgcctcgccccagggtcccctccaacactctctggccttgggcctttgctatacccggggcctggaagggccccctcatcccccaagtgtcaggcaaaggtctcagagcactgtccctgcccggcgtgcttggtcctgactgctaggccccaaatcattccttttcccattacctcttggtttctctgtagctggggtcactaccccaaattcttgaattgactgacgtgtccaactatttcatgttttccccctctacactgggagccctacaagggcagggccccctgggcaagaatagtgccagccaggagcccctggagaagatagctacacatgtgccccaggccccagatggcactcagccctgcctgtcaatgctggacatagggcagtttttatcctggctttctacacaaggaggaaagactaaccatgccagcgggcagcggccggatcacgtatgtcagtagaactctgacccctgagaagcctggaagccaaaccacacctctgtagcaatcacgccacagactcaggccacggctaacggctgccagttcacctatttttgcccccaactcaagaccaactggaggaaggcaaatatgtccctgacgaagggtggccgcctccagcctccccagcccagagcctcagcctccccagcccactgcctccagcaacacacatctgaagccttctctgttggttggttttattggtattttggaagattgtttgttttttgttatgagatggagcctcgctctgtcccccaggctggagtgcagtggcgcgatctcggctcactgcaagctccgcctcctgggttcaagccattctcctgtctcagcctcccgagtagctgggactacaggcacccgccaccgtgccaggctgatttttttgtatttttagtagagacggggtttcaccatgttagccatgatggtcttgatctcctgacctcatgatctggccatctcggcctcccaaagtgctgggattacaggcgtgagccactgcacctggcctttggaaggtcttttatacctttattgagataaaattcttatgacataaaacttagcataaactgtagacttagttggtgtgactttagagtagtctcagaattgtgcaaccatcaccactgcctacttttagaacattttcaacatcccaaagacagaaccccgtaggcacctgttagcagccactccccacccagtccacgaagccccaggcagccactcaccaatctactttccattaatttgcccattctaaacacttgaaaaaaatggtatcacaatggtcttttgggtttggcttctttccctcagcatcataccctcaaagttcatccatgttgtagctcgtatcggtacttcattcatttttatggctgaataatattccactgtatggatagaccgatattttgtttatttatttattcattgatgaacatttgaattgttcccactttttagctattaaaactagtgctggctgcgtgcagttgctcatgcctgtaatcctagcactttgggaggatgaggcaggcggatcacttgaggccaagagtttgagaccagcctggccaacatggtgaaacccccatctctaataaaaatacaacaattagccagacacggtcatgcgtgcctgtaatctcagctactcaggaggctgaggcaggggaatctcttgaatccggggggcagaggttgcagtgagccaagatcgcgccactgcactccagcctgggcaacagaccaagactctgtctcaaaaaacaaaacaaaacaaaacaaaacaaaccagtactgctatgaacatgcatgtgcatattgttatacagacatatgctttcatttctcttggatacacacacacacacacacacacacacacacacacacacacacacacgtatatctaggactggaattgctgatttttatggaaactctatatttagcattttgagaaacggccagtctgttttccgaagtggctgcactattttgcattcccaccagcaatgaaggagggttccaatttctccatacctctgccaacacttgttattgtctgtctcttttatttatagccatcttgatgggtgcatcgtggtatctcgctgtgttttgatttgcatttccctgatgactaatgatggggacatcttttcatgagcttatcggtcatatgtacatcttctttggagcaagctctattctaatcctttgcccatcattaaaggtaggtggtttgtcttcttgttgataagttagagttctttacatgtttagatactagtcccttatcaaatagatgattcacaaatgtttgctgtcatttcttgggttgtctttccacttccttgatggtgtcttttcacgcacaaatgtttttagctttggccaagtccaatttatctattttttcttttgttgcctgtgcttttggtagtgtatattaaaaaccattgtttaacacaaggtcaccaagatttattcctatgttctttcctaaggattttattttttcttttctttttttttcttttttttgagacaaagtctctctctgtcgccaaagctggagtgcaacggcacaatctcagctcactgcaacccctgcctcctgggttcaagcgattcttctgcctcagcctcccgagtagctgggattacaggcgcccaccaccatgcccagctaatttttgtgtttttagcagagacatggtttcaccatgttggccaggctggactcaaactcctgatctcaggtgatccactcgcctcggcctcccaaactgctgggattacaggtgtgagccactgcgcctggccttcctaaggatatcataattttagtgcttacatttaggtctacgatccattttgagttaatttttgtgcacagcatgaggtaggggtccaacttcattcttttgcacatggatatctagttgtcccagcaccattttctgaaaagactattccttcccccattgaattgtcttggtacccttgtcaaaaatcaactgatggccggtctgaaggtagtgagttatctcaattgattgttcacagtcagttacagatggaacacctcgttctactctttcccgccttctcactgctgcacttgaacagtctttaaaaaaatcaattgaccataaatgcaaggatttgttcttggagtctcaactttactgcattgatctgtaggtctatccttatgccagtaccacattgtcttgattactgtagctttgcagtaagtttgaatcaggaaatgtgagccctccggttttgctcttctctttctagattgttttggctattctgaaacccttgtatttccttatgaatttgaggatcagcttgtaaaaagacagatgggattttgatagagattgtgaagctatagatgaattcgggagtttggccatcttaacattatgtctcctgatccatgactgcaggatatctttccatttaattcgatactctttgattcctttcaaaaatattttgtatttttcagtacacaagttttatgcatcttttgttgcatttatttctaggtatgttctttttgccaatattataaatgagattgtcttcttcacttcatttttggatggttcattgctagtgtatagaaataaaatcgatgtttgtatattgatcttgtatcctgccacattgctatgcatgtttattagttttaagggttttagtggattttctatatataatgtcatataatcagcaaatagaaagtttaatgtcttagtccttttgagctgccacaacagactaccataaactgagtggcttataaacaacacaaatgtatttcccacagttctggagactgggatgtccaagatcaagacacccgtaggtttggtgtctggtcggggcctacttctgggttcatagatgactgtcttctcgctgtgtcccccccatagtgaaaggaaggggcccagggtctttctaaggcttcttttataaggacactaatccaatataggaaggctctgccctcataacctaatctcccaaaggcctcacttccaaattccatcacctggggagtaagaatttcaacactggggggacacagatattcagacatagcatttttcttcttcctttctaatatgggtgcccttgacatctttttcttacctaattgccctgccagagccttccagacagtgttgaatggaagtggggagcattcaccccaccttactcctgatcataggggaagaactatccggctttcaccactgagcaccacgttagctggggtatttttgtcagcgctctttatcaggtggaggcaggtcccttctatttctagtgagttcagtgcttttttttttttttaatcagggaagagtgtgagcttgtgtttgggtgccttccctgcgtctgttgagatgatcttacggtttctgtctcttattctattgatatggcgtatttattaccttggttgctttttggatgttgataacatccaaactcttctgccaccccttttaatagaaagctgtacaactccccaacctgcctgggcgtgtctgcccaagatgagtgctagtggccgactccctgctagagtgagcactgcataaacagcctctgcttgtcctcatttgagtgatcttcatgtattccacgagaaatcaaggcacaggggtctcatggtctcatgaatggctccaccaactgaaggtgtgctccatcggggctgtgagtcacctcacgccaggcagaaaggtctctctgtcaaacatggcttcaaggaaccagggacctggttcctcccacaggccaggccctgcccctaagtgcaatgggaatatatgcacatgtcacctgtcccaaaatgctgggagatggcacttctgcagatggggaaactgagggaccagcccgaagtcacggggaggggaagactcctacacacagggaggagaagaacccagccgggctgcaaacgcctgcccttcctcaacgtgcctccggctgtgcccacatcgctccagcagctctgccttcctcaggcataagccttctcagggcaggggaggcccagggagcggcgctcccatcccaggccgggctgctgagcaagcccctcccctttctcccctcatcctctgacagagtccacctgaatatttgtcctggagccaggatggaagctccaccaggcccagctaacaacaggaaccctttcagacgcacttctgggtgcgtactgtgccagtatcacacagacacaagccatgtccttgtcagccatgggatccccaaggtccccatgaggtcacaccagtgggccactgggaagggcacttcagatgtggagctcccatgggccaggccctgcgaagtggtcctcctaccccctcatagccagtcttccctgtgagcctgcaagtgactgtgaatgtgagttccactctggagctaagacgggctgctgcccccgcaatcagatgtcaggcccatgaagccctccatcatcccactgcagtcagaataaaatgcagcctccctctggcctccaggtcccaaggccagcccccctgcctcccaggctcacacctgcccctaacctgtgtccagcccctttcccctggctctgtctcctgcttcccttgtgttcctccaacctcacctgtctgtctggagtgctcctccccggctctgcctagctggctccttctcaggcatcagggcctggatccactgtggctcttccaagcctctgcacttggagtgcctcagccccgtggttgaggagtgccccaaccctgtgaccctctagcaagcatcctaggaattccgtccctccccagcactgatatgaccatcgtgctgtgacacgtgtcatctccgccagagttgcagatcctccaggggaggggtctgctgcctggctcccacagccagggcctggaacagtgcctgacacacagcaggcacccactaaatatttgatgcatggctgaagaggacaggcaggctggctgctggctgggcatggcctgcttctgaggctggtggtcaaggacacagtgtgcatggatctgccccctcctcccacttcctgagagtggagccagtgtctccctccacctaccaccccctgctgaggacacagctcacacctttaacgggaaatgtccccatcactggggacagcagggagctgatgggagagcaggtgtccaggacatccagagaaatgtttcctcacactggaacccttttctattcccttctaaacaaaaagaatcctcgaagactctcaagtgaccatatagtgtcttttcttataatgtcacttcgacaggcacaaaatgtaaaaccaggcataaactactagtgcttgcagttcttacgcaggcatgaagccaaaaccagtttacaaattaaccaccaagaaaaccggtagagcacagatgatgacgatagagctgttttgtccaatgtgagcgctactggccacccagggccatgtgaatttaaattacgatgaaacacaatgaaaaatttggttccttgtggccacatttccagtacccagtagtcatctgtgccagggggttatccaggtacagaacattcccatcgttgcagaaggttctatcagctagcactgggttggacgacacttgccaagacgagctggctagaggatggttctccggacctggtcccacgtggttcccaggtaagcccccgcccaggatgcagccccgttgtccatcagttttcttggagagggcatgggaaaccttcgtcagtgtgtcatctcctgcaaaggccttcgctccttcctctggggagaaagcacccttcactctctgaatcattagcccaaagcagtaagtgcagcaggcctggccccacaccttccggaagagccacggtgtgaggctggcatccctggggcacgacacaaccaggatgtagacgaaatagatgcaatatctggaggttctcctataggtgtctctggcctcctggacacttcacactgttctgggagctgccctctcaggccccagtgaccttttcagatgcagactcccacagcatgggtcagcaattctccccttccgtgagacagggattggttacctgtactaggaccttgaggccaacactgactagggggcctcatgcctgcccaggttccagccccggagagcaatgtgagcaaagcttgctgtctttgcaaagccaaccactgtggcatcaactccttcaggaagccctcccggattgtccaaggtgctcacctcctttggggagccctcccagattgtccaaggtgcttgagggagggaggaatgggttgttctcccggcaccggggctgcactcctgggcagacgctgcatgcctgtcctcaggcgcggccctgctgccacccccttgggggctcggagcgcgacagcagcttggggacgcctcccgcgcccagcacggtgcacctgggccctgaggtcctggccgaaacgcgccaagttgggggtaggtgcagcgaccccatacccctcggctgcgcgccctggcggcaggaggcggggccgggggcggggcgtgagctggccggggcggggcctatggaggggcgggaccgcggcgccctataagtactgcggagcgaggcgcgcgcccggccagagagcgagcgcgcaacggcggcgacggcggcgaccccaccgcgcatcctgccaggcctccggcgcccagcgccccacgcgcccccgcgcccccgcgcccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctgggtaagggctgcgccgggggccggggcgggagggggcaggcacacactccacgttgggcaggtcccgcggcagcgtgctaggccccgcgggcgcagcgcgggccgcgaagttgtggggccacctgtgggctccaggagcggggtggggggtcgcccggggccaccgcgccccccgacattggggctgagggctgcgagccgagtttcggggcctctgtgctcgggggcccacctctgcggccgggccggggcttctgggggccgccgggcagttcccgctgtggtggtgatgggtgcggtggtcgcgggtcgggacccgagtacccggccgcccctcagctaaggaggggcctgcgcgggtccctggccgcggattccggactgctgcttcgcggggacgaggggggggctcgcgggcgggactcctggcgccccgcccccatgagctcatcaagagccgccgcccctggatggtggggcgggggcgcacactttgccggaggttgggggcgatccgcctcactctttccccagcccagctcactctccaatctgcggtcaccacccgagaccttcctgggggtcgcgcctaaaaggagcgcagactcccgccgggatggcccagaagctggggtgcgcgcaccctggccgtccctgcctgggagccgatctccctctcctcacccagacacgttccagcggaggcctcctcccagaagggctctggaggcctcgcaggagtggggatcccgcggttctgagttggcacaaggaagagagtggcaccaggggcctggagtggatggcagggtccgggagtggggccgctgctttgcaagaggggcccccacgctgggcatctttgggtgccagcgtgggtggaggagggtcttttgctgagaatggctttctcctgaccgcagtctttgctgctgggaagtgactgatgggctttcgccttttgtttccatttcctgtcggtgttagaattggggagggggtggaaatcccttcttggcctggaaggactggagtgggtgtccatggccgcggcctccccgtggccacgcccctgggcatagactgcaagcccctccccgtgccccccaggctgtcacccccttctcgtggaagactcggctgatgtcccagtggaccgagtgtttctcaagttgaggcagggagggcaaactttttaaatggcccctggagccagtgtgtgggaccagagacatctgtttcccatctggacggctgaggatcccagtgcggatgattatttggagggggaaggacggaggctgaactgaactctcagctgggagatgagtggggcagtcacatcccaccttccccaagccgggctgttctgcacagcctgcttgggacgctggtgggagtcactgtggccttcggcactgccctggcagtgggggcagctaggccatttgggaggggctcgccttccccaggcccggccctgggacctcagccgttgcttagtggtggcctgcttcagcccaggcatgtgggagaggcaccagacacaggatgtccctctgccagcccctgaagccccgtcccctgacgaggcgagtgtggacctgggggtgggggctgagggagactgtggacctgggggtgggggctgagggagggtgtggacctgggggcaggggccgagggagggtgtaggcctgggggtagtaggggctgagggagagtgtggacctgggagtaggggctgagggagggtgtaggcctgggggtgggggctgagggagagtgtggacctgggggtaggggctgagggagagtgtggacctgggggtgggggttgagggagggtgtggacctgggggcaggggctgagggagagtgtggacctaggggcagaggctgaaggggagtcacgggaggggacttctccggaggtggatttttgctctctggacggtgtgtcagcactgggtgagcccctcctgcctgcccaggctgagaggtctccctggcagccccctgggagtgtcgccagggcgggcctggaagtttcccaggcagctggggtggagacctgacacatcccaagggtgcttgttattaaggctcaaggaaatgtctctgaggcctcaccgctcctctccccagggcctgctccctgcaaagcattgagaactgagtccgtccacagtcactgtggacccacccatccactggggctcagtggtagccagcaatgccaggctgggtgaggtggggttggtgggcaccaccctggtggacccccctccaccctggtgtcgcagggtgtgtggctgagagcacagtgccatgggcttgggcctccttggtggagtccccaacacactgctctggtcctgggcctcggccttccccgtctgcagtgggggcccacagtgagcctacctcctggtggtgttggtggatttgctgacatgcctgagtgttgacagggggcttggtgcaggaagggctcagggcgtgggtgttggccaggggtccaaagggacctctgcctcagagagcccagcccagacaggcaggatgtgcagtggggaaggggctgcgggaaccctgcagggtccagaaggacacagtgcagtcctgtgggctctggggaggctggtggggaggaggttgacaatggatatctgggtggggcacttgttagaagttccattttagagaggaaagaggccttgcctgtgggagaaggcagctggggtagcctgacctctttcccaggaaggagcccacacacacacgcacaggcactcacacacacgaatgtgcacacacacacactcccaccttcacacacactcacactcttgctgtctcccttcccaagccaaggtgcgagggggaaggtctgggcagcatgcacctgcgccctgaccgctttgggggccagtgagaactgggctccctgggtgcgcggcgggcccaagcagggaggacattgcagatgccctggccaagcagcgtggaaatcctgtcccttgggtgggtctcggagcctccatcagaggcggctggcacctgagacccacctgctgccaggagcagggcaggagagtttgtgtcccgggacagggaactggcctgtgggagccttgccttcctcatctgtgtaatggatataagagtcttctcctcgggggctggccagggagtccagaagaggtgtcaccagtccccgcagggagaagagcggtgtcccccgcctgggactggctgctcccccaagctaatgcagctggtagccacctcccagtggcagggcagccaaacccggccgggaaagagactgattagaagcctcgctcacgggtatttctcgcttccagacagcacatgactgtcatttggcacgtctttcgccgtccttccgggagaggggctgcaaccctggcaggcgctgtgggggagggggctaggacatcctgtgcctggtttcaccaagtgggtgtgtggactttccctggctcccccaggctgtctggctgcacagctttggggaaacggccactgggtcaagcgggccgagaagaggaagtctgtggtttgtctctgctacagactggccccagtgaggctgtccagcagtgcagggcacagagcaaaagcagggaggtatgggcctacttccccggtcgcccctgtggctggctgtggctctgccgggtgctgacaagtcactcgccctccctgcggtcaccagggtgcatgcccgaaagccctccattctttcctgggtttgagggtccttctcctgcacccaccccagcgcccagttcagctcaactttcagaaatctggttcacccccaatccctttctcataactgcttccaagcccagacaaggagacagaccccaaaagatccctacccctatttccgcacctgaaatcgcaccacgggaagagctttgctcatagagtcaataaggcttagagtccaggcgcctgtgcgagggagcaggtcatcacccttgtacccaccgtggttttagacaggaccctgaggttggggtggggctggggctggagaggagccaggtgccctgccccttgcttgggccccgtgtccctgtgatccaggctgggcgtgctatgggtgctgggtgatattccagccctgcaggtgtccgccttgttcccagcacccctctgggcaagaagaaccaggctctcccagaaatgggcttcagtgatctccacttccaagtcgtccccacctgccttgtaggacacagtggtacctggtatgctgggcagccttccaggaacctctggacttactcagtgtcccccagccctacacaccattctttgtgtttctgggcccaaactaagccccccaacctgggctgcagagcaagtgctgaatcatgagagacccttgagggtcctccaggtaggcccccagtgctggaggagtcccctcaggcagggggccacgcccaagggtgtggaaggtcagctggcagccggatctcacttttggggctgtaggcttcctgcactggccgccaatgccatggccgtgggatggccaggataaggcatctgccccccacccccaccccccgcacaaggtctttgagggctgcgggctcaaggagttggcggtagggctgggggaccaggggcacagagcttgtaagcgcctctctccaggatgtgggtggcccagcaggggagctttgagagtccaggtgtgagattccaaatgctaggggcctgagaggagggagccaccagcttggccagagcctggtggatcacgcccccaccacgccttgcccttctctctggtcatgtgctctcccaccacgtttggaaagttactgcttccctcttcctcagcccctcgggctcccagttatggaagtggcgtgattcagagaaggtaaaggatgggagggagagggctgggtgatgggggaccccgcagggcgccctgtgctgttacatggagctccaggatcagggcaggtgggcagcctggggtcctcacttctctccccagccaggccaggtccctcacagccctgccaggagcatgatatccgctgcggtgcagaactaatctcaaagctcaaacccaggtaacagtgtaggtaaaacagatgacagggcatgagactcaccccaggacaggcgaaggacccaggccgatgggggcccagaacagtcctgatcctggagctccttcccgagtgggaccccaggggtttccgaggggcttagagtagggcttagaggcttagagtagggctagggacttcctggcttccctgcctcgggaacagctggtcctggaaggggcttggtcctcggggcactggtgcccaccacccctgatgcctgggagacaccagcatcctctgagcatgtgtgcgtcctcctggtcccgagggaagtgactcctcacatcccccagctggcggggccagagggccagcatcctcgcctgacacctatttttagatgctgagacaggcggcttcctcggggccaggggccctgtgagtggagcttccgcttcctggcctaggagagaattcctgctcctcttccctccatgctgccttttcgcccctggaggccacaacggggtcagaggggcagctgctcaccacctaggagggcctgagagggccctacgtcacccagggaggagtctggccccgtccccaacctccacacccaggcctggcactgccccttcttggtgggcagagagtgaggggttggcctgcagggacccaggctggaggggccgttcacctccggcccccagcgtcccttcctggaagcaccttggtgagcccctcccctccttcacccagtatctccaggggtacttcctcctttccttcctgcctcagggcctcactgtcctcctggggagggtgtctcaggccccagcacctcccagtggctgagccgaatgggcacttcccggtgtgtttcccatatgtgcagtccctaggtgtcggtgagcaggcacagagcccgcagcgtggccctgcctggtggaccccctccccaagagcatcaagggagggcctggactagagacacacagatgcccagcctgtacgtaaaggcgggtgagctgatgtaccatcgtcctcgtcccccactggggtgcctgggcaggacttggggtgaccacttggcccgtctgggtgggggtaaggtatgggtggggcgaccagatccctgccctttcctgcagctgtgggggtgtgtgtgctggcctggagagctcccacccgaagttctggctcctggctgtccggggcctgcgggggcagcgagcagctggcatgggtaggggagctgacctaggcctgcccgggcagcgcctgctgccttttgctccctttcagctgcttcttggaaacagcggacaggctgggcaggaacccagtgtgcttggcagccccccttttaaagtcgattctgttatttattaattcccaggaaggagaaagaaagaaacaatccttcatagagtacaaacactgcttttagtagccttgcaaggagccctccaggaaccccacaggttacctgggctccatcctgagagccaccctccatccccaatccccagcagagcatcttgtggggtggggcggcttgtggggcggggcgccttgggaggcggggtgtctcgggaagcggggcgtctcgggaggtggggtggcttgtggggtggggcatttcctggggtggggcgtctcgtggggtgggacagcttggggggtggggcatctcgggaggcggggcgtcttgtggggtagggcggcttgtggggtggggcatcttgtggggtagggcggcttgtggggtggggcatcttgtggggtgggacggcttgtggggtggggcatctcgggaggtggggcatctctggggcccggccacttgggaggcggggcatcctgggggcggggcatctcagagggcgcctccggaggctggagtatcttgggaggtgggagcaggtggcagagaggcttcccacaggtgagctttgagcagggaggtgcctgtatggatggctctgtggggagaggggtgacaggagttccagattccggcacttatgaaacctcacagtgatggagagccgagtgctgctgtgcaggctaagttgtgtgcatgtcagcttctgcacttttatttccttgtttgtagacaaggcagagagaagctgagatgggcctgaggtcgccttggtgaaaggcactcagcagccagggccttgggctgccctccctcatcaccgtgaaagcgggactctcttttaactgacatcgggctccatagttactccagtcctaactttgatggatcctaaaagtgcacttctaaggacgcggcttcggtgtttcccatgccgctgcttgcccctgggaagcgttggctctgcctcggaagaagttagcgccaagatggcagcctggggtctttggggcccagaagaaacactggccccggggagttcagtcatcagggacttaggatgtgggggcttttcaaacagctttatttagacgtgattgacacacagtaaatacagatgtttaagggtacaacttggtaagttttgacaaatttatacccccgtgaaaccatcaccaactccccaggtgcccctggggcccttgggatctctgcttcctgcccctcctccccgtcccagggcaaccacgggccgtcgctgtgggtgcacacagcatgcatttcttcaacaagcggactcagaaggcacttgcacatcgttgctgttctgcctctttgcttcagcatgattacccagaggcgcacccgtgccgtggcctgcccgtcgtctatgcacccgtgctgtggcgtgcccgtcgtctgtgtggcatgcctgtctgtgcacccgtgctgtggcgtgcccgtcgtctgtgtggcatgcctgtctgtgcacccgtgctgtggcgtgcccgtcgtctgtgcacccgtgctgtggtgtgcccgtcgtctgtgcacccgtgccgtggcgtgcccgtcgtctgtgcacccgtgctgtggtgtgcccttcgtctgttccttttattgccgggcagggttgcacccacatgtgcaagccagcgacggaccccaggttcacccgttcaccggtcagtgggcatatgggttgtttcagtttggggcatttacaagaaacgtgctagaacatttgtgtacaagtcttgtgtgaacctaagttcatttctcttgggtaaatacctgtgcgtggagcagctgggtcatgtggtgaatgtgggtttcactgcttaagcagcagttttacataactgccaaactgttattcaaggtggctggaccgttttacagcccccgttgtatgcgtcccagttgcctcccccagcagcatgtggtgtggttggtctttttcgtggcagccagtccactgggtgcgctcggcatgtggctgcagcttgacctgggtttcctggtccctggcaaggtggagcatctcttcatgtgcttttttgctgtgtgtggatcttgcggggaagggtctgttcctgttttttgcccatctttcaaagattgggttgccagttttcttgctgttgagtttggaaagctctgcatacgttcagggcacaggtcctttaccaggctctgccccaggtctttcggagagcaggtgtctttcgcattcctgactctggggaacctctagccctgccacatggggtttgttatggggcaggggcacctgtgcctttcccaccacggggcttggggatttggtgctgccattgccctccctcgtaggtggccctaggggggtccctccgcctccgtttcctcatccagaaaccggcagtgaccatcaccaccattgttgtcacctagctccagctcaaggtccctgctgaaggtcggagagcttggcatggccccgtttgtccatgctagggctgggaagaccaaggctcaggtgaggcctctgcccagtgcctggcactccttcttgccccatttttccacccagggtggctcccgactacttctggtagcctcggggacagttgaggtggacaggctggcgtcacccccatttccggctgtccctcccaccccctcctggcccagctgttctgccctattaaaagtcacatgggccctcgggtccttcctggtgttggcccaggctctttcaggccctgcaggccaggaccagccttccctgcaaccctcggcagaggcctggggccggggcttgtctaggggcagcctccccatacggccctggagtctgaacagaagccccttcccagagcacagcaagaagctgcaacgtggcctgaagtcccaccattagcaggtttggggtttaggctgagctttgccatcactacctttctgttaggacggtatgcccattagatgggatcatcccctcagcgcccaggctagaggaggggtggtccctgcccagccagggagggctgggggtggatgggcctctacagagcagcttccgagccaggcacggttccatgatcagctctgttttatagagggggacactgaggaaccgggagcctggggaccttccagtggccccacagctcctgtggctgagtcagggtttgtcaccaggcctctgtggggatgaggctcccccatccacctgccccactctgtcctggaacagctctcaaaacggtctctggaccacagtttcaaaagaaaataagcaatgttttcaaaggccctggaggaagccagagttaccacggcaactctcggcctcgccacctcctcccgccaggctgcatctggagccagctcaggagggcagcagggtgaggacagccaggctctctggggccaccccccagcccccacccttcctgcctctcctgcactgtccacggccctccctgtgctcccacgggtataatgggcacagaagaaccaggagctgtctgcccctgcaggattctggaagccaggggcccctggcctccctggggccttgtcatgtgaggggcacacgtggggtcccagctgccacatggcttccagcgctgcccgcaggtgtatgttgggcccttggtgactctaatgcaccttccactcggcacagaagagcttcagtctggggcctgggcgggggaagtaggctgccatcctcgctaaaccaaagtgtgaaaattgagttgaaactcccataggagggcaggaggcacagctcctcagaagaaggtctgagaaaccacagcccaggttgttgtttcgggtgtgtggagaaggtgctctggcagtcctgctacagggggaccatcaacagcccctttggggtgagagccccgtggctgctggcaccagcagcccctatgaggcttattttatttttgagacagggtcttgctctgtcaccgaggctggagtgcagtggcacaatcataactcactgtagcctcaacctcctgagctcaagcgatcctcctgcctcagcctccaaaggtgctgggattacaggcgcttgctaccacgcccagccccctctggccttattgtttgccaggcccagctcaggtcccggaggaggggagacaggagtgtgagggaaagggggaagaggtatagagcccccagctcctccacccacccgaaccctcaccgaggccctagaccctagaccggcctgaccggggggtcctcaggccggggacttgggtgcaggccatggtgctggggcctgaagctcacgctctgctgagcacagccccctgcccaaccccaccctggggccctgcttccctggccagggccattggaacaggagtggggctgtccaggtggtgttcttgggtccagccctcagtttctcttctgcagttgaccggcagccctgcatctgtggtggggtcggcgcctggtgctggtgaggcaaggcctcagctgctgggacaggacctgcctggcacccagctggtggcagagccaagcattccgactcagctctgggagcagctgccttctgggctggcattctccgccaggggggttgtgccctcgtggccccccccgggtgcctcctcacctggctgatttcatctcctgtccccctgcctcctcctccaggaagcccccagggcctggccctccttgagagtggcatggaggaggaagaagactcgcccaggcccatgggagtcggatggtggccgcacttgtggggccctgaccccataggcttcttcagcacgccctggcctgggtgatccctgcctgagggctgtgcacggctcatctgccagaccagattttaggggattcttgtactgtcctcctggagcagcagggggtaaagcctgacccacccagactgtccagcaacaagggcctcctgctgtgggccagggaccctggaactgaccaattgtgtcctagggacgcagagtccccaggctgctagagggctgtggggccctgtttcatgcctgaagcaggaagaaaccccaggagaggtctgaaggggacccagcccccaccctgtctagcagggaggagcctctgcaagaggccgaggggtgctgaagtggaggaggatagaggcagcaggactcagggtcactggtcatttatggggatcacacggctgcagtgtgccctgcatggtgctaggcaccagggacagcagaggacaagcctgtgtcctctcccaccaccagagggctgggcactgcccctagggagagagggggccttggtgtgtgcagaggggggcctggggcacgtgcctggcctggtcagatgatcagagtgggctgggctgggcctggtctggggcccagtctcaagggcagaccccacctggctagagttgattgtgtgcacaccggatgacccggcgttgaaggcctctcctctctgtgagcctcatccccacctgccagactcccagcacagcctgcttcctgccccagctgctgagcgacagcgctgggccggcttctgcgcgccccttcccccagcccatcttggaaaccacagcagcgtccttcctcccaagtcccttcccagggctgacatcccacagcagggatgtatcccacaaaccccgcaggccctggtgcctacagcttggcctggtaacatcaaatcctaccctctcctcctggcagcaaagatggggtgcccccaccccagagttctcagcacccccagacagaagcagtcccccagcgacctcagaactcttggggcgctgccacacccttgcaggagggggcagtgttcctgggatgctcaggtcctggtatcacctctggccagatacggaaggtgaaactacagggcatccaattcaccttgaacttcagataaacaccagattatttttttgtatgtcccgtgcaatatttgggacacacttaccctaaagaagtattctgttttcatctgagaggcagatttaaccggcgtcccgtgtcttcctggcagtcctgccctggagtcacactccacaggtgcagggcagggccaggctccaagtagatggcggccaaagcacccgccccatgctcctgactcccggggctcttcagggcattgcgaaaaccagcagcagagctgacacctggtccctgctcgggagccagcaaggcaggaggctgcttaggccttgcgtgtggggtgggcgcactccctgctgcagtgctcttcgtacatgtgacactgttcccgctctttcccagctggctggaggcgtgatcctgggtgtggccctgtggctccgccatgacccgcagaccaccaacctcctgtatctggagctgggagacaagcccgcgcccaacaccttctatgtaggtgagtgcacatgtggccgcagacgcattcagggagggcttctaggaggaggcaggtcctagccttttggatggggacatggagggtgaaagacagtcgggcatggcgtgtccgggcagggaggcggccctggaaagggctctgggcacaagggttgagatggaggtgggcctgtggcctgctggcccttctggtctgagccagggcagggggtggcagctaggcctgggcagggactgtgtggagaccttgcttattttaagtgtggggttatttcgggggaggctccctgagaagggtggggctggatgcctgggccacacagagcagccgaggcagctggcgctgtggagcccgggagggagggagggatggagctcaagggatggaacccagtgaggggtggagacggggcaggggaggggtggagaggggtggagacgccccagaggcggtgtgactcagctgcccctgcaggcagctgcaccttgctgccttattaggctgcgtgtgggggactgggctgccctccctgcccccaggagcaggagcaggagtgatggaggaggaggaggggaggggcaaggccaggaggaggaggagggccatctcactgtgcagagagcagcacccttcctcctggtgcccctggcagggctggtgctggtggggctctgggagcatttgttgagatgcttctggccttgaaaggaggcccctgggatggctctgttgccctcacaggctgaggggtgggtgaggtgggcagcctgtgtgtccccagtcctcagggcttccctcagccggcaggtgcccccaggcctggagctgcagggccaggccccctgccagttacggaggctgcttggcttggttgctgaaccagggccccaggaggccgaaatagccccacacctgcgccgtcccacctctttgtccagtcaccccagggccaggtgagggccctggccacacagcgtgcccgttccttcttccccatgccccgctcatgggtcagagggccggtgctggggtccagatggtgtcaacagggatggtccctgtcctccccagagacagaagcctgtggcccacggagggtttctgggcccagccgatcctagggagggtcccatggccctgcccataggttcctggcctctctcggggccgtggtgccctcacaggtggtgtcaggaaggacgggaaaggctgcttgtcccaggggctcatgtggagaccaccccctgcacgcagctggggcgctcctgcctgtgtcctcagaagcactcggcttagctttgcccatgtgcctgggctgtgggtggcagagcccggccagcatcctccgatctccaagggtgcatctctactggaggcccctcctgggcctcttgctccccgcttcccagatcattaggatatttggggtccagaagggcctcccagccatcctgggccttgtcctccggggccaccagtccagccagtgacaaccacagcatccccggcctggaacgaggctgcccccagcacgttcctcgtactcctgtccagggacaggaggggctgcccctgccaccgagtccccttctccaggacctggggcctgtgggtgtgaggcaggtgttcttggaaggggtcactctccaggcacccggcggccaaggcttgtggctggagcagctcccgctgtggggtcggcgtcgggccccgtgtggccggagaggagctgaagggtcacttagcttcgggctggggcgaggacaggggacaccccagagaggtatgccaggcctccttcctgcgccccactctcggcagaagcagaggtcacaggctgtgctgaggccccatggtgctgcccccatgatgccagggtgaggctggcgttggaagcaggtgtctgacctgcatggtgtcaccgtggccacatcagagctccagccccagagccgcccaccctcggtccttggctgtggtttccctgggctggaggagcctgccgttgtgttggccacacgaccacaggacctgccacccccgacgtgggctctgcctgggcccccactggacagggaccccttggagctcctctggccaccaagtcctcgcccattccagaatcggccttctggagcctcttgctgtccctgatgcgggctgggccttgccaagggctttttttcctgcgccgggaacagggtggatttgctgggctcactcccctcagagacgctgcgggtgcggtgggttaggcccaagggcgttaagagaggaggctggggtggggctggggcctggcagggggtctggcagccctgggcctcccacctcctgtcaggaccaaaaaaggcaacgcgcctctcctgacctgtaccccggagtgaacccaaccttgcaacccaggagtgtcagggcctgaggggagggagacctggctcctgggtgccgtgcccgtaaggaggtggccacctgcagggcattcctggcagaggcttcatctggccaggtaggaggctgggtggccgagccccaaatctgggtgtgttctctgcctggcggtgggtcctgccccaggcaccttctcctctgggctggctgggcagggacaatgggcctggctgcgaggagggggcctgggctgccttctgcattgcctcggtgacgggagatggcccctgcctgctgagggataggggagtgggcaggcagtgagagacactgacagctgtcccgcgggtacagggccctgtctgggtggccaggcccatgtctcgggcccacagtgcgccccccacccttggacggcgccttctccctccccaggtgcatgctgcccagccagggagcgtgggggagttcgggagggctggcctacacgccctggtccagctgtcccaggtggggtgctgggcttcagccctcagcccagggcctaggaatccaacttgatcctccccacacagcagccaggttcaaatgcaggtcccgtaacggaagtgctgctgtgcagcccagattggggggcaggagccagcagggcccccccaccctcttctcgcaccacactggggaggcagcattggttccagttccggttcctgggctgccctctcaaccccggcctacagtggggcccaccctgtgccttctgatgccactcccaccccacgccaagtcccagaggctttgggagcgggtgaaggcggtgggtggcgggtggcaggtgcaggcggtgggtggtgggtgtggcaggtggcgggccccaccgcaggtgtcatccctgcgaagcacctgtcgccagcactcagagcgctcatgaggtgcccagtccccatgtggcctccttagtctccgtcctgtgtcatggaagaggtaactgaggcacagaaaactcaccaggccaggctgggatgtgaggtcccttgctgctcatccctggcagtcagcaaccctacatcttcccagctgggcggcccgtggtgggttcggcacccaggaccctccggggtcttgggctgtggcgagtgtgtaggcacccacctggtgtctctctccccgcaaggcatctacatcctcatcgctgtgggcgctgtcatgatgttcgttggcttcctgggctgctacggggccatccaggaatcccagtgcctgctggggacggtaaggcagggaggcgggcctgtgcctgggccggggaggggctgggggctgcgtctggccctgaggagggggcagagctggtgctcagggcggagcctagaattctgggggaggtggctcctgtgccctgcttttcccgtttggtttttaaattaaatcccaccgtgcttggtctccatcgtggccagttcctacgtgaccgcttttctttgtcaaaaaatagccacaaatataacagggagcaagcctcagctctgaggccagcctcggcgtcccgggcacaccgccccctgtgggaagcccaggcctggctgtgccatccagggcctggccagtccaggaagagggagcctatgcccgtgtctccagtgggggaaactgaggcagatcccatggctcccccttccgtggggagcaggaacaagggggtggggaagatcagtcaggggtcatgctgctgcacacgcctccctgggggctgcagacatcctggactcaccagcctgtgaccccaaaccacacgccccgccccatccaccccgtcctgtggagcctggtgccgcgtggggacatcctgggctttgacggctcctccctgcgctgagttttagcctctgtgccccagggctccacacaagccgctcactcctggtcaggtcgtgggctggtggctcccactagcccctcacagacacgcctgctgggcacctgggtgtgtgtccttgggccccgcctacagcctgccctctttcctccctctggccactgcccggctccagttcttcacctgcctggtcatcctgtttgcctgtgaggtggccgccggcatctggggctttgtcaacaaggaccaggtgagcctgggtgtgcagggacagggtggggtgggtgacgggggcaccctcctctcctgtcgcgggtgggggttgggctgactcatggcttgtgggagctctttgggctcttcctgggtcccacttgccaggaggatctccaggggctttatggaggaggcagcattggggctgagcaccaggccagcctcccgtgtcccagcactcccggggcagctgagagtgcagagtccttgtcctctggggtctagcctcgaagccaccctgcccagggagagcctgggaaaagtgcgtccgcctggggcggggcggggtgggggcaaggagggggaggttccccctgtgcatgtgaccgcacccctcccccagatcgccaaggatgtgaagcagttctatgaccaggccctacagcaggccgtggtggatgatgacgccaacaacgccaaggctgtggtgaagaccttccacgagacggtgcggccccggggggcgagggcggggagcagggccccgggaacccggcggggtgtgtctcgtcctggatgaatcctgcctacgcccagacctcaggagcaggaggtgcccttgggacctccaggacccctggtctcaactggtcctcgggtgggaacctagtgggccagggtggcccagggtgcggaaagctctgagcagcgcagctgaggaggaagaaggctggcccctggatgcattctgcagtggggagcgctgcgtacccctggccacctccccatgggttccctagagccaccgtccccctgggcacatccagggctgaccttgcacccctgctctctgcagcttgactgctgtggctccagcacactgactgctttgaccacctcagtgctcaagaacaatttgtgtccctcgggcagcaacatcatcagcaacctcttcaaggtgcgcgaggccggtggggccgcgcctgaccccccgcatgtcccgcccctgggtggggtcctaggggtgggcaggtcacacggcagccccacagggagcgaccacactgggtggcatggcccctgtcagggctgctctgctgggagggttggggtgggaccgcatctggcccacgaggaaggcaggcgccctgtgctgcgcattccgggtgaagaaggtggaggctctggggggtgggaactcacctgcacccccagctccacgtgtgcactcgtgggtgtggacgcccctgacagcctgtagctggcagggcctgcaggccatatagtgccctgtggaagtttcctgctgaggcctcagtggaagtcgtcatcagtgatgctttaggggtctagtgacaccaatgaccgtgatctcagtggaaaagggcacagtgtgtcccaggcatttcgcgtttatgttaaaacgggtggaagatagcaagccggcagaggccgggccgctgcacccgcctgttccgaggtgggtagggggtggggggctgttcccaggattcccctctacgctttctgtggtgaccacggattactgcgtgacaacgggaagccgggagccgaggcccggtccctgaccacgcgtgcctggccacccctgcaggaggactgccaccagaagatcgatgacctcttctccgggaagctgtacctcatcggcattgctgccatcgtggtcgctgtgatcatggtgagcgggcgggggcggagggcctgctctctgggctgccccttccgcggggccttgtgctgactgcgccccccaccaccctcctgcagatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaccaggcctgtgcagtccctcagtgccagtggtgtctgagacctaggggttggccggagggcaggggaatctgacatcggtggggcttggctctgtggactctgtggggtccagggtgagggtgggtgggtcgggatccctggtgttcaccaaaggagtcactctgtaaaatttggggagttatttattctgagccaaatatgagcaccggtggcctgtgacacagccccaggtcctgagaacttgtgcccaaggcggtctggctacttaattgtatacattttagggacataggacattgatcattacatctaagatgtacgttggtttagtcggaaaggtgggacgatttgaaggggagggactttcaggtcataggcggattaaaagatgttctgattaataattggttgattttatctaaagacctgaaatcaatagaatggactatctgggttaagaggagttgtggagaccaagattattatgcagatgaagccgccagattgtaaatgtttcttatcagacttaaaaaggtaccagaatcttagttaattctctcctggatcaggaaatagacctggaaagggagggggattctctatagaatgtagattttcccaagagacagctttgcagggccatttcaaaatacatcagagaaatatattttggggtaaaatacttcggtttctttcagggcctgctgtcacgttggtatcttattactacagagtctgttttgtgagtcttaaggtctttttatttttagacagagttttgctcttgtcacccaggttggagtgcaatggcgtgatctcagctcactgcagcctcccctccacctcccaggttcaagcgattctcctgcctcagcctcctgagtagctgggacaacaggcatgcaccaccccacccagctaattttgtatttttagtagagacggtgtttcgccacggtggccaggctagtctcgaactcctgacctcacgtgacacaccaggttttgggattacaggtgtgagccaccacaccggactaaggtctctgttttaatgtgaatgctggtcagctgtgcctatgaggcatgttcggccacccacagtcatcatggcctcaacgagcttttcaggtttactttagaatgcatttggccaagaggtgcccattcagttggttggggttgcttagaattttactttgggtttaaaccagggagcaactccaggtagcaagggccctttttgggagcgttctctctattctcttttgggagaggccctgtgttgcctgcagccacttccaccctgccccttgggcacacaaggggcacacagtgtaagcaggtgggcaggaggggtcgggcagccagggaatgcagtgagatgggcttggggtaggggctgggtgcgctgcaggactcctcttcctcctgagggatggtaaaggatggacacactgccccctcccgagcatttgagggtctctgccctgcccatctgttacctgtaaatgttcctttgaggagctgatggctcaggcctgagccacatctcagagggtctggaggggaagaaagacctcatcctactagggagcccccccagcccaccagcgagcggtggttgggggcagacaggctgtggggctaaggagcccctgcactcccccgtccttttccctttgtctgagcacctccagccagtgggcttggtctagactctcctatctttccccacatcgtggggtggggcttgctctgggttaggctacttttccctagttgtggggaggggggtgctggcacatttcactgttccctggaggaaatgagtgcctgggaattcatatctagggctcccagcagcctctttgcaggccaatttggaaactgtccccagccctgcattttagggggttacagagtctctcagcaggccctcctcccctgctgctcccaacttgcaagcctgcactggttgggagaacataatggtccaaggagccccctctctactttccgctgtgttccctgtggggagggaagagcagtttaagaaataaggaatcccaaaggcgcacagcagaccgggggccgaggagtgggtcctgcttcccctccttttttctaggctgagccacagcaggtccttgaatcctatttcccagcggatgccaggacagcaggccctgggggagttctctctcgagcctttcagagggaccagaggtctagcagccaaggagaactcagaatccttgagtgtgtggggcaggaactctcccagctgagaaggggcacaaggtgccaaccatctagggcccagtggccaaggaagacgcggcttgtcgcagggagaatctgggccctggtcctccctttcagggcgggcagctgacctgccccctgctgcggacaggcgaggccaggctgctggctcgcaagcatggcggagcccaaaccttccctgctgccgcccgcccagccacggctgacttggaagcttgaggagcgttcagcagcctccatcctgcccgggaggaccggggacctggaagggcctggccctcgcttccctgcagcgccctagggggacgtctcagtgcctcccggagcccggaccaatgcaccagagctgagggcccaagggtgtgagggtggccgggcagtggccccgaggacggcgccccacaagtttgcggccagggcccagcaaacccctaggggtgggaaagcgtcggcccagctagcgggtccagcagggctgcccccttcaccgtggcccagcggtcacgaccccacgtcctcatcgcgggctgggactgcctctgcgtctggcctgagcgggaccgtgggatcctggggagccccgcctcggtgcactgacagagcccagaaggagtgacggttaccgcttccggtcaggaccggaagtgccgggaacggcattcgtcctccgtgcgagatgacgcacttcctgcctgaggcggccgctgttctcgcggcttccggcaggtggcgctgagaccacgggaagccagcctggctgtcggttagccctcgagcattctgggaattgcaggcctggcccctcctcttcctgttcttggtcaattccggtcttgtttccccaacaaatgccgtcgtttccggggctgcttccgagccggacccaagggccggggcgtggaggagtagaggggcgagcgcatgcgcacaggactacacgtcccgacaggcgtcgggagcggcggcccagttccttgtgggagctgtagttctgcaggcgcggaagccgtggtgctcggccggcagagcactcggtttcccagagggctgagcgcgccgcacggaggtgcggcgccgaccaagatggagactgccgagcagccttgagccggtaggtttgtggtgagggaggacgggccgcgcgggccggccgagcctccgggaggtcaccgagcgcagctttaatacctgagctcgaaggccccgctgtgctcgccgacccccgtacctcgcggccgggcccttgggacccacagcatccttgtgaggcccggaggcctgtccagcccgactggacagtgccgaggggcaccgagagccagcttggcaccgagagttcgtttgttctctggcggggaggtcttgctggcacatatagtggagaaaggccgggctctgcgttcatgtggagaaagagacggcttccttcagcctacggacatgaaggagtcaactctaccttccactcgttgccggctttcgccgagaaccccgagaaacggactaccggagtccctatcttgcagcccgatccccgctacccgtcggagtgccccgctgaccaggctgcttctggccgcggcggcgttccgctgcagaggacgggagtgcgaatctgggaagcagggttctggttgaactccagcttcgtctgcaacatactgtgtgacttgggcaaattatttcccccgccccgttcctgccagctttaaaacggtcatcagtggggggtgctgcgtatcccctttcactggggtggcttcttcactgaggagagtcgcgcctcagaggaactgaggtcctgcctgtgttcgacctggtggggggcactaagagcccctgatagtacccctgaccccatccttattgggtgcacaagacacaggtcactctgggcgggcaaggagttttggtagcaggagaggagtcggtggatggatggctgaggacagtgcagaagggtgtggctgggccgtctttttttgcctggaaattcaagttctgaggcacccagtcactccagcactaaatgggtgcaggaggcagcacttgtctgcccagctggaaaggcagggtatgtgctgagtgttacaggtggaaggccactggaggtcgctccaggagccgcggggatttacctctgcctaacagggctgctcaaggtgatggtcgacaccccactttcctgagagcttgaccctcagatgccagggccttggctgcagattccttgggagctcccggggatcttccagcaaataggagcaaatcttttccccgtggatcaggaaggtgcacgctctttgtggaatacgactgctcaccccgcacagcaagcagcttataagtggccctcctgcctgatttcagccctgggttcaagccctgggtggctgcttactaccaaaatcgctcagtagctccaagcctgcctgcagagggttggcaccattaaatgaggtaacgagtcaaaagtccctaccctgggtcctagcctgtcaggggctccgaaaacccaggctcaggtcggtcctgcccggcacctgtttcacacatgtacactccggtctgaggttggtcctctcccccaccccacccacctgcagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgagaggagggcttggagggggaggcgggactccaccctgtgtgggacagttctgtcagttgaccctccacttgtccaggggcagtggatctgcagggggaactcattctcaatactgttcctcctgagaaacaaattttctgggctgttttggtttaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctccttcaaccaggatccctccagctgtggggaggggagggtcatcttcaccaaaccagtccgaggggtcgaagccagacacgagaggaagagggtcctggggaaggtgggagagccaggcaggggcggccttgggaatcctgccacagacaggggcgagggccctgtggagctggcccatctggccgggcccgggagcccagaggctgaggagtggggcagccaccatggaggcctgcaggaggtggaggcactgtcagggtctgtccacagtgggtctgtgccaggtctcccgccggtggaaactgttggcttccatggcagcaggaagcggagtcgagaccacttccggaacaagagcagcagccccgaggacccaggtgctgaggtctgagagggagatggcccagcctgaccccactggccactgccatcctgctgccttcccagtggggctggtcagggggcagcctggccactgcctagctggaatgggaggaagcctgcaggtggcaccggtggccctggctgcagttctgggcagcatcctcccaagcagagaccttgctgaagctcctggggtgtggggtgtgggctggaagcactggctccctggtagggacaataaaggttttgggtctttctgagactttgtgtctatctgggccctgcttacccaaagggctcagttggcagcaagagctccccacacctgaccctcggtgccggaccactcgagggtggctgacacctgcatccctcaccagcacatcacccaggtgacagtgagaattggaaaccccaggcctcctctagggcttgtggctcagtggcaggtgtccagtgagtgccctcaatgggcctgagtgggtacagaatctgccctcccccaaccaaagcccacatgatgccatcagccccaggcctagtgcagaccacagcttgggaagcgaaagggagatgacaaaatgggtgtggacagaggaggctggggtgagtgggcagttggggggcctgggcaggtgtttgagcctggggtccagttttatctgggccacgtggggtacagtgttttccaggctccactgaagataaagcagccactggtgccagcaggggctttgtcttggggccataaacaccagtgtgtgctgtactggccatcgggtgtcagggggacagctgacagatgcagtggatgcccagccctgtcttccaggagccagtcacctgagccccaaaggaccttttgggtcttaagtgacagaaattctaaccaccagtgtttcaaaaaaagatgagtctcttgtcaggcaacacaagtcagggcaggggtgggtgcagaccccagagcagcttcgcagtctggatgggggtgctcccccgtcacgccacagggccagcttttccacagtgcaggctggtcagtttccaggtagggatgcggtggggcacgttttctgcccggggagttgtgcctgtcaggggagacagccccatgacactgctgtgcctccggggaggccaggagggacaaggagcggttcctttgggtgagggtctgtggtgaggcaccaggagggccattgtctgctggggggctggtgccccctggggggttccgctggaggtcggcaaaggtcagtgcacaacgtgcagggtggccagctgaggagaggtggccccacacgtggcaggccaagcagctcaggtgtccgagggaggctggccagccccgggttgttcccagccatctaaaccacctctgtggtcagcagccaccagctggcttccctcgccacagtgctgagagcctgctgggaaggaaggcccccctgagcggtgggaaccagcaaggcaggcccaggaaggggagaggtagctggctcagaggcaagggccaggacgccgtggctctcagagtgagtccccacaggccagcctggggaagatggggagcccagagacaaccaggcctctgcctgcactcctgggactaggaaagcagcccccttgaggccgaggggcccgtttgcttgctgagcaggacagtccaatagggcccacgccaggcagagcctcaagagtctgagtgaagcacattcggccctggccaaggcagggactccgtcagagggcacccacaccaccctgaagagccgcgtccagccaaggcctcctgagactcccgggccaggcagggaaggcagagcacacagcacagcctacggccccccagccgctgcagagtgggtgcccatgcccaccctcatcccacgctccccaaacaggcttactccgggggccgccaccctgggccagcacgtcagccacggaggacacgagcaccgagcagtagttgatctggagaagggaaacacgtccgggaagctccagggctctctcaggacagcaggggacaggcagcctccccatctcccctctcctgccagggcccccgctgccctgtgactcctccctctgagagctgccgctcacaggcaggggtgagtgaggctcccgtgaggcgtgtagagtgaaaggcgaggggtcttcaatgtgagacccctcatttaaggctgtagcctcccaagtggcagggtgggaggaggcacaggtggggacggcctgtcttccccagaacgctcctctgcccactggggtgctcctgtcctggctctggcctgcctcatctctgtgagtgaccgggcagggctgtggacccatcccagtagccccacgcagccacccgcctcccatcagggagaggagctctggggctcgcttgcctgtgactccagacacttgatgcgcttttcttgctctctcagacccccgaggtacttggcaatgaagtccactctgcggcaggagcaggtggtcaggctgtggatggccacgcggtgctctgcgtgtggggagcctccccatccccccaggcctccctgtgtgcccgagtttggggtgccctggccctttcccttcctccctcatgcccagatctggtggcaccaggacccctcaaagtgcacctggtgcagtacagagcgctctatgccttcccagtagggctagggtgccatccctgcctgggcgcaccacccagaaagacggtgcagggcaggcagtcggggacaggcccctggagccagggctggagggaagccaggggtgggtagtcccaaccctgagaccacagcagggagggcgccacggtcactgtgcacgctccctttttgcctggccaggcgtcccagcagggtcctgcacaggtcaggctggaaagctaggcccctgggctcggccagagccctgcccctaccccttcagcttcagttcgccagctcagatcctctgtcactggcgccaatggcacatccccgcttaaagacagcccgatacccaccagtgatcaggacaggcccccgcacctgtgggcggttttccgcagcacctccccctcgctgtccctcctccgcttctccatcttgctcaggaagttctccttctggactgtctcccaggtgacgaccttctggtccagggggtctggcaggtctctctctgggaaagccaggtggcagccagcattactagagcatgtgggcgtcagtggcagagcccaggcctggtcccggggcgaggtgggccaggcagaaggagtgagtggggcccagccagggatggagggcaagcatggccctgtgcaaggacggccaagctgcgggtggacgggctcagctgtgccagcctgcacagagcccagctgaggacccacagggctgaggaggggtccaggtctctccagacctgcctccagcgcacagccccgccctgggacccgccacctcggcctcacccaggtgctcccgcttgtgctcggcctcacccaggtgctcccgcttgtgctcagcctccttcttgaagacccggcggagcgtcaggctcaggtggctgagcaggatgaagggcggggccagggcggggcgctcgtggtactccacaatcaggttgtagcgctggaacttccagaacatgtctgcgttgccctgcaccacctggaacgtgtagctgcaggggcacagctgagccgtcacctaccggctccccacgaccacttgggggacgcatccccctgcaccctgattgctgttggggagccctttttgaaactgaggcccagcactgcttctgcgttgcctctggggtgtgtcacgaggggtccactctccttgggtcttcccctgtccactctgctctcctggacaagcccagagttcttgccacagcaccggtcccccaaagacccaggccctgcttcctgggactgggagggtggcccacagagttcccggtcttgggcaggcaaagccctgcagtccaggctatgccaccttctatctgccctgaggcaccaagcctcaccctctgcagcacaccaggtgggttgcaaaggaggcggtgttggggaatgaccctctgctccctccgctccagggctctctcctccaggggttgggtggagtcacctgaacatggcgatgagcaggttcatgagcagcacattggtgaccaacaggaaggtgaccagcaggaggatgaccagccagttggcatagaggctggggcaggatggtgagtcctccagcagcagtgggtgggtggagcagttcacacgggcttctggaaagcaagggtgctgtggggaccagaccgggggcagccacaagggcggccttaggcaaatgccccgagatagagcgctgagtcctggtgttgaacccaggggacggggtgctggttgggtgacccactgtcccagttcacccagggcggcctgggttttagcagtgaaagccccatcacagcaaaccagaaccagacgggtggtgagccccaccctgggccccctctgccatgtctgctgagcttccaccaggggctggagtcagccaagatcacaggccctggaagtagagccaagacccctggagggatggaaggtgggggacagaggggtcacgggacccaggtttctcctggttgttggatgtgttaaaacctccacccctcctccgaaaaaagcctctgctgttgaaggtttggggagagctgccgaggaaagggagatggggcccaggacttctcagagcctctacagcactaatgcctgtgattaaaccccaagctggcaagtaattccgccacctttccaaaatgtattgagccagcaggctccagactgggcttgctgcaagctctgagggcaccgatcccgcactgggccactcaagtcaagaacattcttcaggcggcacactctgggagcttgcaggctgagctccctcggccctgggcagggacaccctggaggggtggcagatctcactccagtcccttaaaaccagaccctcacacctgcttctcccttgtagggctcaaccctggaccctcaccccaccccagcctgcggggcaggaggagggaggagggaggaaggagccgcagtgggcgtcagggtgctcagggtcccagccagaggccagagtgtgccctggccgtccaggaccacatatcccctccatatccgaatgggagctccgctctctcctccctccccagcctgcacgctggcgtgtgtctgtgtgagcctgtacatgtgattggatgtgcctggcacacatgctcatgtgtgagtctgcgtgtgagcacactggcacacacgggcacattcaagtgtatcttagtgcctgccagctccaggttgccctgcggtgggttctggggggtctccttgttcccaggttcctgcctctgtgcctgggtcctgagctggaggggtccgttctccctcctagggtgaattcctgccttgtttctcccgagtgagttagtgtgacgcgttggcccgtgtgtgagttattgagtgtctgtgtgtgcactggcagtcagtgagcgccagccctccccacgctcccaccctaggcctgcccctcctctgtccgccctggccacctccagcccatgaatctgttcctgggcagactgatgaccccctctcctccctgcactctggaggagcgggccggggccagcctggagagcctgtttgtgaagccgtaaatctgtctgataaaggcagctctgaggaatgagacccccacaccctccccgactctgtgatttgggaaggcgccaccaggccgggctggaaattaaattgtccctggggcctggagacccagagaacaagctcgtcaccacagctcaaccccagctccggctcggcacgagtgcagagtggggcaggggtctgttctgggctctgaggagacctgcaggctgtacaggaactgtctgagcctcagtctccctctcagcccagcatgtgttagtgaataactccctgcctagcagcatgaggggctgggtcacagtgagtggctggggttcaacctgaagggcccagatacttgctcggcagctgaacggagcccaaggaattgcagctcagggaggggaagtgacaagtctgagactctcagtgggcggccggggctggccctgttgcaggcgtttcagcacggggctctgagatccccgcagcaccgcagacctccctgaggcagcactcggagcaggggcccctcgggagtctgtttccctgccttctcccgtcgagaaggaggctatggccaggcctgtctcctcatacgagtcgctgagactggcccaccagagatgcagccactcaagaaagaggggacccccaaccctgccctggctggaggcgcccgtctagagctcctcctgccccgaggggccctgcggacgggcagtgctggaggccgtatggtgagggcgaggtggggtcgcaggcaggcagggtctggttaaactaatggcctggaaaatgaatgcctgtgatgagcaaacaccaaaatgtcaggaggggctgcgggggctgagaaaacagcccaaggaaatgagccgcgctgggagaggcggtttccatcacggcgtcgcccccgcctgtccccggaggcctgtgtttgctccggtctggccgtcatcccctcaacaaatatttatcgagggtcctgagcgccactccacagaggtcggggtcaggcctgggcagcacgttgtgccatgactgccccgtgccgggcagccccagccgcctgacaccgcctgagcagtttccctgcaccttctctgccgggtctccaagtctgcggcacccctcgagggccccaggggcgggctggctgctggtccaccttcccagaggggtgcgtccctttccaggttggggctcctcactgagtcccagccatcccaggggcctgcacaggtccctgccccaccccagagctccccaccaacccatcactacagaggcccccatggccaagcggctctgacccccgccccctccccactgcactggcttatgaaaaagtttccagagcctccaccagccccagccagctacaggggtcggcctggggacacccataggcatgggcaggccacacacacacattggggtgggtccccaggagcagccagggtgcctttaggagcggccaaatggcgaaggggccttgccagcaggacggcgtaggggctctggtgggtgccctaggccaagcagggccctgtgggagggcagaggccaggggctgtgaggagagctggagggcccagaccccggatgatggctgggacagcctttgggcccactctgtgcccttagtgcctgcctatcccttccccaccgatagaccacccccagagcaagacttgctgcttggcctccccaagcaggaggcagccctggctgccttggggtctccttgtgtctccttcccagcccaaggccccaggtcccaggtcggggctccgtgactggagctgcctctacctcaggaaccaggcctggccctttggggtgtggggggcctggggaccaggcctcagccacttctcccatctctgctccaggctggggtctccatggccccaacagacctctctggagagcctcatgcccagggcttgtgcacacagggctccaatttctccctgcccctgcccccgctggctgtgtgcaaaccatcaatctcgtccagtgggatctggccgaagatctgcaggtagggccggtagagcacccggcggaagatccactccaggcggccgtcatgggggtgcagcagcgcctgggtggtgacaccgtaggccacgagccacacgctcagaaagaagaggaagaagaagacgtccttcatctccacggggcaggggcagagagagggacgtcagcggccagccgggtggggcccaggcaggggattgctgtccctccagggccagggccagggcccccgggggctcaccatgcgctctaccacgatgatcttggggcccagctgcttgtgtatggcaaagatatggatcagccgcagcgtgaacaccatgaagtccatggcgaggactgtgcggccagcctcaaacgccgacggcagcatcctggaggatgggaggctgatgcggctgcggggcccagagaggggcagaggcttccccaggggcacacagcatgctggctgcgggcagggccagggccaggccaggactccttgggccctgagtggcttcatcttttgtttatttatttttaagagacagggtcttgctctgtcactcaggctggagtgcagtggcatgatcacggcttgctgctgcctcaacttccctggctcaagtgacccacccacctcagcctcctgagtagctgggaccacaagtgccaccgccacacccaacctgagtggcttcatctggaagcctgcccacaagccgccctgaggccacacggcctctgggccccacagacctgcaggtgacacccacgatgaacaggaagatggccaccatgtcacacttgttccagttgtcccccacatacagtgtgaacttcttcaccaggtgtgtgtcctcgtctgtgaagaagccctgggagggaggtgggcagtccactgacagctgtccagccgccctcgctggggacagccctacctggacaagcttggatctgtaaggatcagggttccatctatgaccagggccgaggctaccagtgggactaggggtccactgaagctattccagggctgtctggggacagaaggtgaggtcagtctccacttggggccagggcctctttgtgcccagggtctagggatcagtttatgcagtgtctggactcagtccgtgatacaggtcagggttcagactctgacgagggagaccatggtcatgctcagtctggagcagggctcagggctcggtctttgaccaggatcatggccgctggtgactgggaagatgggaggcccccatgctgttcttgttttacagttggggagccccaccctgcgagggcaggacccagcttaggttgcccaacctgaagctgcagagtggaggggacctaggctagtgtggccaccgacctgccggatttcctccagcaccagcgtaaagacccagaagtagagggtgacctcgggccctgaggggccctgggggggcggcctgaagtccaccagcaggacgtaggtgaacaggaagaggaaggcgaagtacatgaccacgttccccaggaacacagtcacgggagcgccccagaatttccgccagcgtgtgagcaggaagacagcacgtgggcctcggtcaccctgagccctcggcgcctccaccagctcctccaccctgtgccgcagagaagttcgcagtggtgaggctggcgcccagccgggtgccccaccagagtccagcctcccagccaccacccgccagtcccctccaccctgcctggccctgtgcctcgcaccggctctgcaggccatacagcgggctcttctccgtgtccaggctgtccaggtcctgcaggtcctccaggcctgtcctcaggggagcttcctcactgcgagcacaggagagctcagggcccgcaggaagggctcccagaggcgcctgcctggctccaggcgcttggccatcaaagtgcccactgggatgcaggggctgtggggagtgggacccgcagggaggctggacttgggggctacagagtcaggctaccaccagcacctgcgaggcccaggccctccccgtagctccggcactcgcactgctgcctgtcctggccgggcagctcacaggcctcacccacctgaaggtgatgaggttggtatagacgagggcggggcagaggaaggctcctagcagccgcaggatgggcgtgcctgcggccatgtccccccaccagatcctggtcaggaaggcctgaggtgaaggcaaaactgtcggctccaactctgcacctttgcccaggctgcgccctgccccaggaatgcccttcccccaggtgcctggcccacgtgagctgaaggggtgcccagcccagccctccctcccggagcccccgtcctggtgggcatgtgctccttgggccactcatcccaggggtgtgggttgagctgctgtacccttcactagggaaaagattgggcttgggggttggggaggactgagaggaggaagtgccacttccactgaggccagaggcaggaggagtgtgcctggtggaggaagccaggtgggcgccttccaggaacagaagccccaccccgccccctctgtgctgaggacgggagtgacagggcagctgcaggctgggaagtcaactcaagctgggcccagctcgcccgcccaccccaccccctggcagctctcctcgaggacagctggcactcacctgaacgccgtcgtgggcaaagaaggccttggcgtcagcctcggtggccaggtgcaggcaggtggtcttgctccagcagcggttccggcgcaccagcagggcgaaggcgcgggcctcactgttgctgtagcactcggagaagaggtctgcccccggaggccctggccgctaggacgagacgccgatgcccggcccggcccccgacgcccctcctccatcccctgcccagacctgggctctgcagccgcaccctgcgttcaacacgcagggcccagccaggccttctgccccctccggcctgctccgggcccttcctgaacctccgtccttctccggctctgtccctcccccagcaggacaaagggaacctctgccacgctaaatgtccctcgtcctgcggcagggcccagtgtatgcccggggtgtgaggctgtatcgtcctcaccacgtgcacagcggtcccacactcagggtctggggccgcctccaccccaggcagagccgtctgtcctctcctatggaggaggcccctgagggcacctggagccccacggcggtaacaggcagccctggcgaggcccaggacccttcgtccgacccctccgtcacatcctcccccgcgcgcgggcccggccccagccgccggtcactcaccaagggccagccgctcgtatttcgcctcgcgcgtggctcgggccgcctcggcctccgtctccaggtgcgacatctctttgaggattttgcaggcggccagtgcggctgccacaccttcctggccctacgagacctggtctcaggaggccgcccctcccctgcccccgcgctgggcccgcggcctgggctcaccatggcccagaagtaggtggccatctcgtggcggttctgcagcacggcccacaggaacaggtcccgccaggggttctcgctcttctggttcaggtccagcagccacttctggcccgtgggccgcttggccgggcccttctcctggaggacacgggcgtcggcctcctgctgcggccccagcctcgccctccatccccacggagcccccgctcaccgccctcctgcggtcccctggccggccgtcctggtagaagcctcggcaggcgtcctgcaggaagtccttgagtacgcgggagacctcgtgcagggagaaggccggtggccccgcgggtggctcccgggcctgctgggtgcccaggccggccagcgtcagccgggcctcctcctgcttccgctgcagcaggtcgaagagcaggctcttgcgtgacacggagcggtagagctcctgcagccgcccatacgtcaggaagtcggccacgtctgcgccgttgtccacaaagaggcgcacaaactcgggcttgttgctgaccagggcgtccaccatcacctcctccaggtcacaggacttggcggccatgggcacccgagggaagggggacaagagagtgagcgagagacaggaggagggggtccaaggaaggagagagcagggagcatggggatccatccccagggccaggtcacgcagaccctctcgctctcctgcaccccagcctgccccctgcattggggcgggcacagaggggccagtcgtgagcaaatgctgagggtgtcacaacccccttgggctttggggacagccggcacccagccagctctgcctgggccagtgagcgaggcagaagcccgggcagaaccgtggcctggtcttgccccggaccttgggacagctgggcagaacgggctcagccaagcagcccacagggtgcaggagcaggcagcgtgggcagctcgggcagtgccatgatggggaggtgggtaggcagggctgggaggcaccttccactccacgtccccattgaagatctcactcttggcgatgtccacgcggtcccaggccacggccagcttgagctcatccagatagtcctgaggctcctggctgtggctcttgcaggctgtgggcagagcaggcaggcactggtgagggtggagctgagggcctcacagagccggggcacagggtccccaaaggtgcgctgcctagagacgcggaaacgggaacttcacgctgggacttgagggggcacatgcgccacctctgagcaccagcaggaggcacgagactttgtacaaaccgcaggagaaagcgtgctgccctggtctgcgtcgggacggcccgtctgctcccatgtgaggcaacttcctcggctgcaacgggggtaccccagctaacacctgggcctcgaggccacttcctggcactgaaggtccaggacacccttcctggatgttgtcgggggagcaagctgggccacgtttcctccacgggcaagggcatttggccatgacttggtgaggtcaccagggtcactcaaggggggcctgcagcacctgggctgggtgcgcctgctggaaaccgctgtcctcaccagactcgcacgtgaggctcaccagcctcagcctccacaaccatggaccccgtaagactacggtgcctctctcaggccactgggaccaaactgagactggtgagaagaggcgggggagttcctaaacggggaggtttctttgacctccttgtcctggtgaggtttctaaacccagagccacccgcagtccagacacccttcccagagcgtcccctcaaggtgtccccagcccctgcttagcagtgcctctccctgctggggctgtgtctgcctgccagcgtccagcccttcagcacgcgttcgtctccagcaaaaagcacatcaaatgctcatcaaaattttccatcagcgggtgaacagacgcatcaaccacggtctgtccacaggctggaacctgactccgccttacaaaaggaatgaagcatggaatggcatacgcttcaacacggaggaaccgtcaaaccctcccgctgcctgcagggaaccatggacacgaaatgcccgtcagcaaatctatagagacaggaagcagatcgatggttcccaggggctgggggaaatggggagtgagtgccaaggggtatgggctctttctggggcgatgaaggcttctggaattagataaaagtgatggtcgccccacctcacgaatatactaaaaaccactgaattggctagtgcggtggctcacgcctgtaacctcagcactttgggaggccgaggcaggcggatcacgaggtcaggagatcgagaccatcctggctaacacggtgaaaccccgtctctactaaaaatacaaaaacaaaattagccgggcatggtggggtgcacctgtaatcccagctacttggaaggctgaggcaggagaatcacttcaactcgggaggtggagcttgcagtgagccgagatcgcagcactgcactccagcctgggcgacagtgcgagactccgtctcaaaaaaccgaaaaccaaaacaaacaaaaaacaacccccccaccaaaaaaataccactgaattgagagctttaagtatagttttaagttgtggtaaaaaacacgtcataaaacttgccaaatacagacagcttcatgaatcatgtgtcatctttcctgggaaggggcaggcggccgagcgtcacaaacattggccaggctgccaaaccccaaagcggctctgagcatgaagccccccaatggcgcctgccttgcccaccctgcccgccctcacctttcaccagcgccttcaggatgaccgtgtccagctcctcggagccctcctgctcgaagtcatacacggtgagcaggtgctggtgtgaggtgatgttctgcagctgggcaccagaacagagcccccatggggccgcctcagccaggacgggggcagaggcaggccgtggtagacaccagcgtaggcacaggcagcgtccccaggtgagccttgcagcctgcatgcccaccgcccaccgggcccggcctgggaccacccgcagaccaaggggctgcctgggtctctctgctccctgtgggcctgaagcgagagtgggtggggggcccagcagcctgaggtgggaggagtgggctggaggctgcattgcaggaactctcccagaggaccagccccacccccggaggaggggtcgggaggacaggggagggggcagcacataccagcttggtccagcgcacgatgtcctcccaagagaaatgcttgctggggaacttctccttaaactgcttctcggccaccttgggcaccaggaggtggggctggttcactagggcagcaagcacatcggcgatgccccccgagcctaccaggatcagccacggggcagcctgctccacggccctggagatcctctgagacggggagggaggggagagcggaccccagattagcccgacgacatctggatgcaggtgtcaggggtgcccccatcccttcagccctgtcccaggggtgcccagaacccaccgcacccctccacaaggcttcggccagccagggggcctcagccaggcccctacctccaaggtgttgggatcaccattgaccagcaagcagaggacagggatctcgatgctgccagtgcctgtggacagggcacccgtgaggcctgaggaccctccgcctggggtgaccacccggatctcaggctctcaggccaccacattttctggccaaaagctggctcttccgaataaagtgtgggcttcgtctgggccacgtgacacaggctgcttattacagcccctgccatatgagggccgagggctccaatgctaacctacactacccagcacgcgcactttgtggcaacagctggcatatggctgttaaaacacaaagtgacgtggaagaaacggagcacccagccctacaggtgcactgccacactgcacgcgctcatgctgagcatggcagaggcagcatctcgaccatcgagggagctctgctgggtgggctgcgcctgaccactcagcaaactgaagaggtacaggagggagtcttcaggtttctcccccaaacagaagctggaaatgagatgtctatatgtgaagcccccagagaggcctggacctgcccctgtcttctgtgagggagtgaactgcctggaggtgccttagaatcacccacagggaactgggctcgcaggcgggcccctgactttgaaaggtgcctcctgattgaatctggaggataaatcaggcctggccaaacggtgcccgggccagcagggcttccgcagagcagagccagaccctccgcctgtgtccctagagtttgacgagactttgtgttttcaattctaaagagtgctcagttgaccgggcacagtggctcatgcctgtaatcccagcactttgggaggccaaagcaggcagatcacctgagatcaggagttcaagaccagcctggccaacatggtgcaaccccgtctctactgggaaaaaaaaaaaaaaaaaaagagccgggcatggtggcacatgcctataatcccagctacccgggaggctgaggcaggagaattgttggaacctgggaggtggaggctgcagtgagccgagattgcactcctgcactccagcctgggggatgggggacagagtgagattctgcctcaaaaaaaaaaaaaaaaaacagagggctcagttggccttgccaagaaattacaattctgtttctaaatattgtatattgttcatagatgttataaataattatatgctttgtttatgaatattatttacacactagcgttttcttagtaagtccagcttttgaacgtgcgactggccagaggtgcccatttctcgggtgacgctgccctctggcggcagcatacctcacgcctggcggcgggaagtagccctctttcaactcacgatctcattttgcctcttagagtcccggagcctctgaccacggcaaggcccagtgaaaacagaactgcacctgctctggtgggaatgtcactgtccagtcagagccactctgtccagctgtgcctccttcaccactctgcccagacagctcctcctcccaggcccccacggcccaggcccccacggcccaggtctcggtgctcaggcatgcggggtgcgttctgcctgggaagccctcccccttctccctggcggtcacccccactctcccacaggcgggtccctggatccccactgggtcccaaggcttccctgggtggctggggcgggtctcacccccgtagcccgccctctgctccgagatgtgcttctccagcctcagccgcagctccgtcagcccatcgcccttccccggggggcctggctccaccaggatgaagtgggagaggttgctgtccagtgaacagagggggccctggctgccgccgtcatcctcagggtagtggacaggaaaatcctcctgcgcccatgcagggagacgaggctgagccctcgagaggcagcttgggctggtcccgctgcgggatcctccctgccaggccgtgcacaccacgccatggggccccgcacaaggcttctgcccgagccttggtttccccacccttcagacaaaaggagggacgaacagctggggcccggggaccctccttcgacagtcaggggcaggggcggtggggagcgggttcttttagacagaaccatggagacagcccaggctgccgggagcacctccttcccgactctagggctggcgtccaaacatccaccaggggctgcccgggcctccctcggtagtgccttagacagaccccagcatgggggacggaagctgcttgcccaggcttggaaagggctcggggcctgggcccgtgtggtacaggagggggtgagggcccgcgccacagtctacgctggccgttccctatgcggtactgccacctgccggccgtgtgctggctctgcccgctccctgctcttcctccagctcgagtcctgtcctcccagagctctgcccgctgcccaaacccttctgagcccctgcctccaggcccccagcggtcgtggtgctgggagctggacgtgcacctgggcctcctccagaatgcggcggtgcaggacgcggcccagcgaggccatgccgacagcaaccacacggaccttggtggacgtgctggccagcgagtggtcgcgcacggcctgcccgacatgcctggccaggcccacgcggagggcactggtcaggatccaggctcctgtggggatggaagagggcctcgttgtgccgcacgccccaggtcttccctagctggccccacgccctaacccctaggcccaatcagcagccagttacctgggagccaggggtgggtgctggggaatgcctcacggtggggtggggaagccgaggcccagagagggcaaggcacccacccaaggctgctcagcagcagaactggctgggcccagaacctgtgaagtggcacccccaccccacctggagcgcacaaactggggtccagtccccccaccgtgctccctccgggacacatccgacacaactctgtccagctgcctctgctgggtgagaatcccaggatgttttcccaaatgacaaagccctcggcccttgtctggctggaagatctctttgggtttgccacagtcatttagtgagggatcctgaaacctcaagtccttttctcctgggtgttgtataggccaagctgcctcaaaaaacagcccagccattggactctggcccctgcagctggcggcccgactgcttccccaaggggtcccaccctgtatacacccgggtgctctggtcccaggtgagtgggagcagggacatctcatggcggcccatgggccctgctagtggagggggcagctctaaggaagggccaggcccagctgggggaggtcctggtccagtacgtaggcactgctgcacctgtgggtactgcagaggacgggctgagagtttcgggaaatgttctcgtgatggcctggagagtcagggggtctggctgccgtgtggggtgggagcattgcctgtgccgggtggggggacagtcagggggtctggctgccctgtggggtgggagcactgcctgtgccgggttgcggggacagtcagggggtcgggctgccctgtggggtgggagcgctgcctgtgccgggtggggcctcacctgtgctctgagccgccttcaccagccccttgcgcagcacatcccgcagccaggacttcatggcgaaaggctgctcctcacccaccagggacaccaccaggttgggggccggcaggtgccactcagcaagcagcaggtcaaagagcacagacggggccactccgctcggcacccgtacaaactgcaaggcaggtctgcagctcagggctttcggggcacggggcatgggagctgctgggcattggggggggctggacacaagggggcactggggaggtgctgagcatggggggacactgggcactgggaggtgctgggcatcaagggggctggacacagggggtaccggggaggtgctgggcattgggggcaggtagcaggaggagagtggcccccaatatcccttctgggacagggccagtcctcccttgacctgctgtgtgacctgggcagtcctgacccctctctgggctggcatccccctcagtgagccgagggcgctggacagaggtggggccctggatgcacttgaccttgcacctccaaatctctcggggggacttcaggggtcccggttattgcagggaggtaggaggccggccagagccactccttccagctctggaactctgcctgtctgggggctctgaatatggccccaggggagcagaccccaggggtgaggaggaccctggcactcagcttccagggaaggaaatggggcctcatgggttccaggtcaaggcggacatcacctgaggcctggggcctgcccttaccttgcctcgcttcttcccagaccctccaaagttgacctcgcccctgtgcaagcccagctcccgccggtcttcagcatccccggggcttccgggacgggggccttggacatcctgcatggtggcctctagagctgcagggataccctggcccttgagggctgagaaggcccatccccacctccctcccctcagggggctggctctgctttcccctgggaagcccctctccagccaacatgcacaaggagacctggggactgcccccaggcatctctgccccagggaccttctctccagccaggccctgcccagcgaccccctgcagctccgacactcgctgtagcaccgccccaaccaagctccttcccaggtgaggatgggatgtgtggggctccgctgtcagcgcctggttcctctactcaccccactcagggcacctcaggttggccacacctgcagacatttctccagaggccttttgtggggatgacctggaaactccgaaagactcagcagaggccttgcagtcccctggccacacagcccacccgctcccaggacagggatgtggagaccctgggtgcacctgggtagaggtgaaaaggtgagacaggtgccctcagctcaagtgcaggaggcggtgtggacgagagaccaccttccttgcccaggaggtccaggaggcccaggacacacagagagaggaggccttgccccggcccacacagcatcagcagcagagctattcccgtggcgctcccacatcagcaagcgggggtagaagaggccgcgtgcgcctcagccctattccctcaaccctcatggggctcatgtctcccagctgcccggtgaggtcgggcatctcagcccctctctatgtggcagggatccaaggatcggcactggcccctcagcgccctggctccgcccctgcccacagcctcatctgtcagctgcccagccccagcctggctgacctcggtctggcttggtcccacctccctccgattgctcctctgaaaactcaatattggaagctggtgcttgaggacaagccctggcaggccgagggcacctgctcctctgtctgccctcctggaaccacgcgtcgggtcacaggccgctgggcagaggtctccgtgggcccccagccaccctaccctgtccgacctggggctacctggcagctcctgatcccacagggctgtcccttggttctcctgtgcccaccttgtacccaggcgctctgggctgtgtccaccacagaagccctttgtgagaagacaatggaccgttctgtaaaaaccttcatttcctagagaggggcccacctgtgaccccaggaggggatacaggagttggggggaacttcagagatgagagggagtgtgtcctgggacccctggggctggctttggggcagaggctaaggccaaggccctccccattaggcctctggagccagcacagttactgcatccccaaacaggtatgtccaagtcccaaaccccaggacctgggaatgtgacctttggaaacaggccctttgcagatgtattaagatgtaagtaaagatgaggccatgctggagcagggggagccctgattcccaggttctgatagagaaaggggacatttggacgtagagacagacgcgcagggaaaaacaccctttaagacacaggggaggggtgaaggcagtggttgggtgatgtggccacaagccaagggacacctggagccccgaagctggaagaggcaggaaggatccccctcgagggcttggccttgccgacagtttgacttaggactcagcactggtggcctccagaaccatgagagaatcaattgccattgttttaagatgcccagctcaggctggttgtcttggctgcccagggcccccctgtgaggcccaagtcaaccccggcacgacttctggtgactgccagccccaggcaggacccacccacgggcctcagccccctcctccggccaggcctgtggaggcgccctgatgccctcagcaccacgtgggcctcagctgtccctgcagggtgatgcaaatcctcccgcacttctgcctccagagcaggaaccagcccgcggaccgcagagaggcaggatttgaatacggcctcccgcgctggtggagacgcctggtggttttctgtgttgggagctggtgtctgtggccaggccccaggtgggggctggaggctgggacaaggcttggcattgctgttgtgtcccggggctgccaaaacaaagggccacactctcgggggctcaaaacaacaaatggatgatctcatagttctagagcccagacgtcccaaatccaggcatcggcagggccgtgctccccctggaagctctcagagcgggtccttcccaccctttccaggttcctgaggcgccaggtgttcctggctgtggccgcgtggctccagcttctgccttggttgccgcatggtctgcctcgcctgtctgtgtcctctgcaatcattgattgcccaggcccgccctaccccagcgtggcttcatcttcatggtgcgccatctgcaaggaccccacttccaaacgaggtcatattctaaggttcccagtggacagtatccaaccattagtgtcgccccatctgggaggacaccacttaatgcagaacaggcagggaggtgggatgtgtgcttgtagccctgggcgggagtcctcaccctgggcgggggtcctcaggctggccttcactcccaccaggccctgccacacctggtcacccgctggggtcaatcctggctacgtgtggacatgtgccctgcagctggggatgcatggccaggcgtgtccccagcacagggtgtagggggcttggggtttggccatgaccctcagcctgggggacgggactgggctggacaacactgttatcctcgccttccccatgactcttaggccatagatgggggactccttcttctcttcccttcgtccctggtggggaagctaatggagggcctgggccttgggaggggtcctacagggctccctggcccttgaattgctttccagtgagcctcagctttgcctcttggaagttctgggataggacatccgggagtacccttcagcctggagctcggcagtgcctccctgactctatgcaagacccccgggacgaccagcagccatcagaggtggaagcagccacaaccaaagctctggcccttcccagggcccacagcacctccttcctcccgaggacgggacagagctgggcacccagcagctgaggtcagggaagccgagtagcagcgtggggcagcctcaccttcctggtggccgcaaccaccccttgccccatgcccaggctcggtgccccccgcccccgccggccagcccagggactaaggaggcatttggccaggtgctaggcaccaggcaaatgggcccagagggaggtgatgcaaacagctgggatttgcatgagcaggtgcccaggtcttctgcacccctccctgtgcatcccagggtggggcagggagcccgggacagccaggggccatcgtgacccctggccagaagtccaccccagaactcccaagaggcaaaactgaggcagccccccagacggtgaaggcgctggggctcccagggcagcggggcacctgtagccgcagccaagagccaaatgtggcttcctgggctccccaagaccagctcagggcagagctggatgaccaggccctggggtcccagccccgctcatccccaccaggctgtgtaactttgggcaggtccctcagcctccctgggcctgcctcatttgtgagatttgggggaacggccagtcacaaggggagggtgccagaaaggtccctgcgtgcagcaggctggaagtcagctgtgtgtccttgtgtcctccctatgaggatgccccatctccctgggctgcagtggaggacacggctcagggaagtggtggcaagaggacacagtagtgacctggtgaccccagacccctcccactgccccactcccttcgccctcagcttctgagccgcacctgcctttgcaggctgctggccagacactgcccctgaagtctcagatccagagcccgtggggctggccctcctgcccagaccctcttccagcactgggcagccccttccagaatgccccacctcaccccagtggggccggcccttcacagcccagggaagcggggatcctccctgctaaagataaggaaactgaggcaagaggcaggggtgtggccaaagccgcactgtcctggtccccactcctctcatgcccacctgcccttcccacctgggaggaggaggtacaatcctgctccttctccccacctgggctgtcagcggtgtgagggtccctacctgtctgccttctccccagcaccctgacacgcggctgctggccaaggcgcgggtggagccgtctgcctaccttgcagggtgtgcctgtgggcccaactctcaagcctctcctcctcctcttccccgcccacaactcctggcacctgggcagccaatgccagccctagggagctggccatgaaccaacacagggcaccacctcacctgctccacacggccgagcccacaggcctgctgtctccaaagccacccagacaccaagggctggccgtcctcaggtgtgattggcaccaaggccctgggggcatgtccgatttgactgggagaggagaccctgtgtggacgtggcttctaggccacttagattgctgtcgttgcctcctttggcgatgtctggcggggtggcccgggaccgatgcagctgaaatccaccctgaaatgtgatgggacagggctcttcacctcagtttccacagtaagtaggaacaggagctgcctcaagagcacacgtctcatgccggggtgctgggcccagctgtcctgtggaggacagggaggcagagggactgtctcctccctgctgtggccctgcgaggccgtggggcatcggcccccatggtgtctcatctgtgctggaaaggctgcacagccgtgggccagctgtgagtgatgtccattcaccggtcagcaccagggatgctctgtgaggactgtccctgcatccggagtcaggacagggtgccagtgggacagagtgtgcctctggaatcccgcagtcctgggattggatcctgcatagctgttgagctacttagccacttgggcctcagtaccttggagtgtcaaacagggactctaatagcctggcttctgggaggttgcaggtaacacatgaggagaacagagcctgggggatacctctgtgtgccccttcccaaagagactccaaggaccccctgttcggggcccctcaaaccataaactccaggaatggtgggggacagtatctgggacttgctctctgggaccctggtggcctctctagtctggcctgtcagccaccagagggcgctaaaggaccatgggcagagtctgaggcagtggtggtaacgggtgaaggtgatggtggtggtggtgatgatggtggcagtagtggtggtggtggtgatgatgatattgatggtcatgatggtggtggtgacaatgatcatggggaccgtgctgatggcggtgtttgtgatgatggtggcggtggtggtgatggtggtgggcatgagggtagttggggtggtgatggcattaccgttgatgagggtggtgatgatagtgatggtgatggtggtgggaatgatgacgaagatgatgatgatagtggtgcaaatggcagtggtggtggtagtgactgtggtgttgttgatggtattagtgctgataaaggtggtgatgatgatgatggtggtgggtgacgaaggtggtggtggtgatgattgtggtggggataatggtggtgatggtggttattgcagtggtagtgttgatcatggtggtggtagtgatggtggtcatgatgttggtggtgttggtgttggtattggtgttggtgatggtgatggtggtggtaataatcatgggatgatgatagtagtcatggtggtagtgacaatggtgacagtggaggggatggtggtggtgataatgattgtggtggtgatggtgatagtgttggtactggtggtggtgatgatggttgtggtggtggtgatgatagtggaggtggtagtaatgatgatggtggtggtagctggtagtggtggcagtggtggtgatggtgatgattgtggtgatggtgatggggtagtggtggttatggtggtgttggttgttatggtggtagtgatgatcatggtggtggtgactatagtcactggtgatgctggtgttcatggtgatggtgatgatgatagtggtggtggttgtggcagtgctgctgctgatggtggtggtgatgatgagggtgatgatgacaatgagtatgatgatggtggtggtgatgatcgtggttgtggtgtgttgatggtggtgtttattgtggcggtgatgatgatagtgttaataattgtggtgatgttggtgatggtggtgatggagacgatgatggtgatgattgtactggtggtgttggtgatggtgtggtacgatggtggtgctgatggtcatgatggtggtgggggtgataatgatcctggtggtggccatggtggtgtttttgataacgtgataatgttggagatggtggtgattgtggtggtgataatggtggtcatggtgatggtgatatcagtgtgggtgatgtagtggtggggatggttcagatgttggtgatggtggtggtgatggcagtgatagttaggatgatggtgatgatgatgatggcatgggtgcttgatatggtttggctctgtgttcccttccaagttgtaatcaccataatccccatgtgtcaaaggcgggaccaggtggaggtaatcggatcatgggggtggtttcctccatgctgttctcatgatagtgagtgagttctcatgagatctgatggttttataagcatctggcatttcccctcactccatcctgctgccctgtgaagaaggtgcctctaagtctatggagttggggggcacagtccttcatctatcctggtccttccctccacctctgtctcctggacacccaaaaaaactgcagaagttcttccccagccaactctggttcagtgccaggtcatgttcctccccgcctacaaccttccatggctccctattaccctgacaataaaacccaaagaagccttggagccttggcttctggtgatctgctaggatcacttttccttggaactcctgctggctccctcttgccactcagatactggcagaacctggagtgggtgctggcttgcactcactccatcctgctgccctgtgaagaaggtgacttgcttccccttcatctccgtcatgattgtaagtttgctgaggccaccccagccatactgaactgtgagtcaactcaacctctttcctcggtaaattactcagtctcaggcagttctaatacagtggtgatactagtggtggtggtggtggtggtggtggctggttgtggtaattacagtggtagtggtgatggtggtagtaatgatgatgatagtgctggtggtgatgttggtggcagcggtgagggtggtggcggtgatggtgacggtgttgatggtggtggtggttttggtggtggtgatgttggtggcagtgatgagggtggtggcagtgatggtgacagtgttgatggtggtggtggttttggtggtggtgatggaggcggtgttggtgttggtggtggttttggtggcggtgatggtgatggtgttggtggtggtggttttggtggtggtgatggtggtgttgatggtggtggtggttttggtggcggtgatggtgatggtgttgatggtggtggtggttttggtggtggtgatggaggtggtgttggtggtggtggttttggtgatggtgacggtattggtggtggtggttttggtggtggtgatggaggtggtagtgatgatggtggtcatgtttatggtagtgatgacagggatgatgctggtcgtggtaatagtggttatggtagcaggccatgttataacgctagcagctttgctctggatgggaaggctccaggtactcccaaagtaggcacctatgggctgctctgtaaatgtccctttgtcccctagcatggctgaaaccctcatcctgagaggagaagcagatatcagcttcctcagtaaatgcaggttggtgttgagctcagaaacccagaacttggctctgagcaaatgggactcagaccagggaccccacaagccctcaggcctgagaccctaaaatcctagttctgagagcgaggggcctatcttgggggccctgggcaaggcggagggtccactagaccctgaaagtccagcctaagctcacatccactcctctagcctgtgtcgttgccctacagcaggttctgccagtgtctgtggtatgtgaataatgaggaggttcccccagatcctctaagcctatggggttgggaggcacagtccttcctctatcctggtcctgccctccacctccatctcctggacacccaaaagactacagaagttcttccccagccacccctggttcagtaccaggtcatgttcctccctgcctacaaccttccatggctccctattaccctgacaataaaacccaaagaagccttggaaccttggcttctggtgctctaccaggagcactcttccttggagctcctgctggccccctcttcccactcagatctcagctctcatgtccttcctcagagaccccctcaccctagaccacatcagcacagggtgcctccctcggtctcttcccctgtgatctggtgttagttttcagtatgcctcaccctctgaaaggtctttcatttacttttttgcttgtctgtgtcccctgcatgagactatggcctgagcattccctgccacctccctggggcccagaacacgcaggtacagaccacatgttctaaagtcaatgaatgaatgagtgaatcaatgggtgagtgtccaggcgtgtctctgtgtgagcactgccatcaaggcagagacggaggtgtctaggggaggctgcatttttgcaaggagcaacttcctggcccacactcacgccctgggtggaagggcagacactgggccggggctccactgtctgcccgctctagccatgggcactgctgccaggggaggaggtgcccaggcgctcacctgcgtccatgcgtgctgtcatgagggacatcccagctgccgacagagcagcctctgcctgccctctacagcgggtttcctccagcggcctctgtcttctttgctacagttggccccgggcaggctttacgttggaacttcctttggaggagaggccacgccagtagagcaggactccaacagggcccagcccctgcccccacggggcctctatccctgggacagcagatcccctttggatctccagcaaccccaatggctgactgcagaggctcagctctctcctgccaagccctgccatgcgaggctgggcccacaggctcagaagctgaccccagtgtccaggagagcgtgagccgtccctgaccggggtcctcgggcctctgctgagagagaaggagctgcaggctggctccccacctgcaccacaggcagcctccccccaggcacatccttgggtgccatgtggcattttatttacagaaagatttgcaacccacttcttctttgtcttagaggggagaaaccaccacccagagtagggcccgctggcccagggtccccatgccagtgtggtgggcgcccccaacccagcatctccctctgaaccacacacagtctagccccaggtgggagggaagcagcccggagcccctcagacaggaaagctgatggtgggggcgtcaggtctgacccctcggggggcagcccgaagccatgcagtggggcagcagggccatgggcaagctctgccagtggtgcctgtgtccaaggcctccgggcagatcctgagtgcccagcagtggagaccaggagtccgggaaccagtggagccgcacgtccgtccccactccattaagttccctggcccgggcagcgcctgcagcgtgccactgctgtctcggcaccatccttgcagcatcaccttttgcctgtccttctactctgggagggcaaccttgaccccatcacaagatgtgaacagaggtagaggccgtaggggccagcgaggccaaatgacctgcccatagcaatgccgccatgaggcaaggcccacgccctctcccctgctgtcctgtcctggagcttccacagctgcaggaagacgtccccctaccctgctccccgcagagggtgcttggcgatcagacagcagatctgcaaaggaaggtgtagccttcttagtgtgcgcaagggctgcccggccaactccaccattgagggcagatgctggctgtggagaggccgagcgctgcccgggcccagtggctggggtagggggctccatgcactgtccatgagggcatgtccatctggcatatgtgcacctgtgtgagtgtgctgtgtgtggagcgggcactgggccagtggtcaaggctgcagtaggactttcagtgattccagatcctgtctggaaatggggatcatgagaattccttccactgaagggtgcgtaaggcctgagccagtgtgcctggaacgtcctgaggaccagcggggccggggccaagacctggacagggcctgggtaattgcgagaagcaaggaccagcgtgtgcctgtgtgtgtcactgtgcgcacatggtgtgtgtgtgtgcatgcatatgtgtggacaccgtgggcatttctgtgtggatgttgtgtgtgtgtagctgcactgtgtgtgcggacagcaggtgtgcctgtgggtgtgtctgtgtgacactgtatatgagtgtatgtagacattgtgtgtggctgtgtgtggacacagtgtgtgagtgtatatgtgtgtgtaggtggactgtatgtgtctgtgtggatctgtgtggatgctgtgtgtgtgtatgtagacactgtgtgtggctgtgtgtgtggacgcagtgtgcgcgtgcatgtttgtgtaggtgcactgtgtgtgtctgtgtggatgctgtgtgtgagtgtatgtagacactgtgtgtggctgtgtgtgtggaggctgtgtgtgtaggtgtaccatgtgtctgtgtggacggtgtatgtgtgtgtatgtgcaccatgtgtgtctgtgtggacgctgtgagtgcatgtgtgtgcgtggacactgtgtgtgcgtctgtgtggacactgtgtgactgcatgtgtgtggctgcactgtgtgtgtgtggacactgtgtgtgcaaatgctgtgtgtgtgtgaatgtgtgtaggtacaccgtgtgtgtctgtgtggatgctgtttgtgagagtgtgtgtgtgtgtaggtgcactgtgtgcggacactgtgtgtccggctgtgtgtgtgtgtgtggacactgtgtgagtgcatgtgtgtatagccgcactgtgtgtgtgtgtgtggatgctgtgtctgtgagaatgctgtgtatgagtgtgtgtgagtgtatgtgtaggtacgctgtgtctgtgtggacgctgtatgtgaaagtgtatgtgtgtgtgtgtaggtgcactgtgtgtgtgtggacactgcatgtgtgtctgtgtggaaactgtgagtgcatgtatgtgtagctgcactgtgtgtgtgtctgtgtgtctgtgtggacactgtgtgtgtgtgtctgtggtgtgcaggtgctggaaggcaggctctgcaggtgcagctggagcttcaaagtgtgagcattgggccaggaggaccacagcctggctgatccaggggagagaagtcgtttctgaggttctggaaatgacagccattgggaagcaccacaccgccactcatccatgaactcaaccatccgatcacccatcagttcatgcagtcattggatacagatttttgctattcatttatctacttacttttgtagagatgtggtctcactatgctgcccagactggcctcaaacacttggacttgagcaatcctcccacctcggcctcccacagcactggattacaggcatgagccaccacagccggcctggggagagatttattgagcgacttctatgtgccaggcactgtgtcagggggagacacagacaacaagcaaggggatacgtgagaaagaaggaagatcaatcgatgattaagatggctatggagaaaaataaagcaggggaggcccagcggctgcaagattttatttttaaatgggcgggtcgaggaagaattcatggagaggctgccatctgtgcaaataactggacgaagggcggcccatctgctggtctatccacccactcactcacccacccactcatgcacacatccaccagcacatatgcacctcctcacccatcaccacccacccagccatccagccttccaccagcctgcccacctgtcattcacccatgcacccatggcaatccatccctccatccgtccatctgtccattcgtctgtccatccatccacccgtctgtctgtcgattcatccatctatccgtccatctgtctgtccatccatccatccatccatccatccatccatccatccacccatccaccaatctatccatgcatccatctgtctgttcatccatctgtccatgtgcatctgtccatctgtccatctatccatccatccatccaccaatctgtgtatccatgtatcaaactgtccatctgtccacccacccacccatccatccatctgtccatctctctacccgtctgtccatcacttcacccacctgttttctcctctctccagttacccactcaccacttactaacttctccacagtgcctagtctctccaggatggcgagtcagtctctggtctcaggatgcccacactctggggaacaggcagcaggtagccatgggggattggccagagcaccccaagagcgtaggcagttctcgtggtttctccccagccagcgtatctcccagaagaggtcactatcctcgaggccaggagcctcaccttccgctcccctgacctcccccacaccgtaacccagcaaggctgggaattcagtaggtgcccaataaatcccggcaggctggctgagtcatcccacctcctcctcccctactgatcacccattcagctcctggccccattgcccaaaccctgccagcctttgggtgatctgctcagccgccacctcacatccactctcagctcggggccagctctgggctccagcccgtgatgggccatggtgggcttcagagggtgagccccccacaccattgtaccagtctggcaagacggatgagtgccctggtcagtagtggcccaccttggcctggaaggatgtagggacaggctgcccacccccatttgccctccttctctgagtggctaggacagccaccaccactctccagggaggggaggggctggcctgtcacacgtcccggacaggcctgcctgggcccaggaaagggctatgtgtgtaggtggcaggctgctgccctgggcaggggccccgccagggctggggaggcctcagacctttagattgtggggctggtccccagcactcccactgggggtgggaagcttggcggccagtgacgggagggtcagcagaggggcccgtgctcctggctgaagccaacctcccacacaaggtgatgccgacaactccaagaatcgatgctgtgtcaggagcagtctccggaagtgatttccgccagatgggctgggcccaggtgggaatctgggagcttccccagaacagggagcatgagaccagctcagagagtctgcagtgacatcagatgacctaacctcagatcaaagtgaacgcagccagaagcaccccgctcgcccacctgggcactgggccgagaccctgggtcctgggctgggaggagtgagtgtgggtgtgtgaccttcagggagggccccgccaccagccatgagcccacagggtgtagctccccacctctctactctgccccactgctttctgtcctgggtgcacctttcccagcctgctggatcctgctgctttaaggctgcctgtcttaggagaagggatgggggatccccaggtccttcatggtgacaaaaaggctctttcacacatgcacacctacacatacttgcacacatgtgggcagacacacatacagcctcagtcttccctggctggttcccagcttgtcgtcttggaagaggaggaggtggggtacacccaagctgtgaattgggagacaggtcatgacacacccatctcctacatctcctgatttcacaggtgagaaaattgccttggtggggagccctggcttcagtgtgcatgtggacctgcttctgggtggggggtgcctttctctatgaaggtgtgtctgtcctgcaccactgtgggattcaggaaggcaaggcctcttgtgcagtgtgtggggcacagtcaatgccggtgctgactgtggagtgaccatctgacatagcctgcaatcaggaaggaccatgtcaaggcagaactgaaggaccctgagctagttctggctctgtcctgctgtggtgcccaaacttggggaccctcaggacattccaaacctcagggtctcctgcacaggagagaggggagtacactaaaatgcagattcctggggccgacccagccccactgtactgggtctgcattagaggctgtttacagagcccccaggcaactgccctggggtcccctcccagacctgctggtaggggtgggtctgagctgaccggtctttatgagcatgcgggggcaggtagttagggaataggtgaggcagtgatgaaccaggaaccgcctgtggggttaggatcaagaacaggggcttgctgatgaacgtaaatataaaaatcctcaacaaatactagcaaaccaaatccagaaacacatcaaaaaattaattcaccacagtcaaatagacttcattcctgggatgcaaggttggttcaacatatgcaaatcaataaatgtggtttgtcacataaacagaacaaaaaaaccatatggtcctctcaatagattcagaaaaagtctttgaaaaaatccaaacatcccttcatgataaaaacctgcaacaaactagccatcaaaggaacatacctcaaaataataagagctgtctatgacaaacccacagtcaacatcatattgaacgggcaaaagctggcaaaagcattccccttaagaataggaataagacaaggatgtacactctcaccacacaaaaaaattacctaggaatacatctaacccaggagatgacgcatctccacaaggagaaacactcctgaaagaaattggctggatgcagtggctcacaccagtaatcctagcattttgggaggctgaagcgagcggatcacttgaatccaggagttcgagaccagcctggccaatatggtgaaaaccccaactctacaaaaaaatacaaaaattagccaggcatggtggcatatgcctgtagtcctagctactggggcggttaaggtgggaggatcacctaagcctgggaggttgaggctgcagtgaaccaggactgtgtcactgcactccagcctgggtgacagagtgagaccctgtcttaaaaaaaaattacagatgacacaaatggaaacacattccatgctcatggataggaagaatcagcatcattaagatggtcacattgtccaaagcaatctacagattaagcgctattcctattaaactaccaacgtcatttttcacagaattagaaaaactactctaaaattcatatggaaccaaaaaagagccagaatagccaaggcaatcctaagcaaaaagaacaaagccagaggcatcacattacctgacttcaaactaatgttcaaggcgactataaccaaaccagcatagtactggtacaaaaatagacacatagaccaatggaacagaatagagagcccagaagtaaagccacacacctacagtaatctgatcttcaacaaagtcaacaaaaataggaaatggggaaaagactccatattcaataaatggtgctgagacagctggcttgccatatgcagaagaatgaaactggacccctaattttcaccatatgcacaagtgacacaagatggattaaagatttaaatgcgagacctcaaactataagactactaagagaaaacatcggaaataccattctggacatcagcgctgggaaagaatttatgattaatttctcaaaagccattgccacaaaaatatacattgacaagtgggacctaattaagctaaagagcttctgcacagcaaaagaaactatcaacagagtaaacagacaacctacagaatgggagaaaatatttgcatctatgcatctgacaaaggtctaatatccagaatctataaggaactcaaacaattcaacaagaaaaaaataaataaccccgtaaaaattgctcaaaggagatgaacagatgcttctcaaaggaagacatccatgcggtcaacaagcatataaaagaaagctcaacatcactaatcattagagaaatgcaaatcaaaaccatagtgagataccatctcacaccagtcagaatggcctttgttaaaatatcaaaaaacaatacatgctggcaagagtgagcagaacagggaacgcttatacactgtgggtgggaatgtaaattagtccagccactgtggaaagcagtttggagatttcccaaagaactcaaaacagaagttccatttgacccagcaattccattaattcctggatacatatacaaaagaaaaatcattctaccaaaaagacacctgcacttccatgttcatcgcagcactattcacaataacaaagacctggaattaacccaaggtgcccaacagtggtagactgggtaaagaaaatgtggtatatacacaccatggaatactatgcagccatgaaaaagaataaaaccatgtcatctgcagcaacatgggtccagctggacaccattatcctaagcaaattaactgaggaacggaaaaccaaataccacatgttctcacttataagtgggaaagtgggaactaaatgatgggtgctcatagacatagagggacaacaatagacactggggactggtagatggtgggggagcaagcgttgaaaaactattggctaccattgtcactatctgggtgatgggatcatccataccccaaacctcagcatcacgcaatatacctatgtaacaaacctgcacacataccctctgaatctaaaaaagaacagcagggccttaaatggggtgatgccttacagatgtagggcatcatatccataggagacattcgccaggcataaggatcctctggagagacacatcagcttgaggaatacagggtggtggctctgtccagccaccctgccccatctcctaccctcccatccattctgcattgggtgcctcctgcatgcagagtcctcctccaacagcaaatgcctcccagatttgctgaagggcctgctccagggtctctgtggagacgcccctgggacccttgctgaccaccctccacaatctgcacccccatcctgtgcccccttcgttttttttgtcccaccactacctggtggtgagacagctctgtaacctgcgcctagaacagcgcctggcactcagccggtgctctgcgaggatctgggggaatgaacgaatgattgaatgaatgaataggtaggaagactacctgaaggaggatgttggccaggaagcctgtggtggcctggctgttctagcagcccagccctggcccgcagatgctgatctcacagcagccacacacccttcccttggtcagcctcagcttccccattcctcatgcattcttggtgacttctgaggctcctcccactgtgggcctctgaccctgctggaggaacatgaggtgagcctggtgagctgagggatgtcggcaaacagccctggaaggttggtgtgaggtagattgagtgccatgtttccagaaggttctgaggctctgggacagcctgagagcctgagaggctgggagagggttgccttcctgttcatgctggctgataggtctgtcagtctttgcatctaggacagccagggctggacatgtgcacccaccggaatgatagaggaggggctttcctcagtggagggtgtgtcctggagagagcaggtggcagctgggaggctacaaccctgcggtcctgctccctcagctgatgggggccctcctcacctccttgctcacacagagagtggccactgggctcggtcaggccccacttgtattgtctgtcctaccaggccatccacccttactcccccaccctcagcccttggcctcacctgagcccacacccagcccagcccagccccaccttacctcacctgcgcacctggccttactccctcctctcagttccccacccatcccccttcagctccttggagcttgcagggagcttgaagacaatcccttgtccagtctctctcctgcctcagtgtccccaagccaatgggaccccatacccccagagcagcaggctgtggcacagctcagggcccaggagacagccctgggggcctccaagaagcctccctagtgagttattagaattttttttttttagatggagtttcgctcttgtcacccaggctggagtgcagtggtgcgatctcagctcactgcagcctctgcctcccgggtccaagtgattctcctgcctcagcctcctgagtaggtgggattacaggtgtgtgccaccacacccagctaattttggattttcagtagaggcggggttttaccatgttgaccaggctggtctcaaactcctgacctcaagcgatcagcctgcctcggcctcccaaagtgctgggattacaggtgtgagccactgcatccggcctagaatttttaaaatatggaggcttgacctgcctgaccgccctgccttttcactcgttttcagaataatgagcaaagcaacctgcagaagatcaaataggatttttcagtattatcatgaatgcatgggcttttcagctatttgatgtgttttcatccatgactctttctgatgctcaaattgtcccattgttgatcagccccttctcaaacttgacaatgaacaatagtaggatatacctttttcctaagataaaatagctgaggagtctatgctaatatagtccattcaatttaaggactggtttgtacttctttgattttttaaatctgtatcacttttatactgaaaatcttggttccaaaggaatttagcatcattctttgatacacacacacacacacacacacacacacacacacacacacacacagagttctttgggatcctttggttgagtattagtgatcatattgatcatggcactccatcgtgtgactgtaccacagcacagctgaagcgattgaaggacattgtgattgtctctagacttttgctaatataaaaaatgctgttttgactatcattatgtatatgtacttttctatttttcctacatatctttgggttatttcctagaagtggggtttctgtgtcaaatgatacatttagtaatatcgctaggtctcttttctaccagtgatgaggagtgcacctgtgcctgctgcctctcccacagagttgccatcaaaagtctggatttttgccaatctgataagcaagcagtggtatcagagtgtacttttcatttgcatttttcttgttataaatgaggttgaacattttttcataagtgcaaaggtcatgaaccccatttcctatgaactgctcatgtcttctgctcccttttctataggactgtctggcaggttcctcacctcagttttgatgttctttatgtatcagtgatattaatcctttgtgatcgaaactgcaaatacttttcccatttggtcatttgtctcctttactttgctaatggtgcttctattttaatttttcttattttatctgttgcttttggatttcaagtcatagttggaaatgttttcccgattcacaggttcttgaggaattgacctgtacattcttgtagaatttgcatggcttcatctcaccctttacacttgagcctctgattcatttgagatttattctcgtgtgcggtgagatggacccaaggtatgctttttctttctttatgactgtccagttgtccaaacgctgcttattcaaagctcaccttcctcctgctgaggtgggaggggaaggcagagactccatgcaggtgtatgtatgttcacccggaaagtaactgctgaatgcgtgctgtgtgccctgcagagctgactgactgcccccatcttctgacccgctgcccttctgcaccttcactgatatgcttcccaggaaggtaccctctcctcggcctcccttgtgttatcacagcgcccagcacaagctgggacccactccatccactcttgctgcaaatacagactgtgcactcctgtgtggcacctcactagggtggggagtcaggcgtcaagggcctgggctggactccgtccacgataaaagagcagacttttggcagggggtggtagatacatcaaattgacccagggtgctcagggacgacctggaagtgtcacatgagttatgggtctcctggcggggcggagagtcaccgctgagctccacctttagtccctgcctcagggctgtgtgcagtatcctgaaaaaagccggtctcttctgttggctgccccccaccccccccccaagcctgagacgtgctgagacccaaatgccagtagcgggcgggaggcagtgcagagacctgtgaaaatcttccgatgtgaccaacccacccccacccaggggaatccacggggcgcagcggcagcgcggtctcgacggtggggaggacaaggcgcccattctccaagttactagggtggcgcaagcgcctctccctttaactgcccaggcagccccgcctgctatgcccggcagtcaaaccaggtccagaccccggctgtgccgcccccaccccccagcagccctgccggctccccacccacacagctcccactgggaggtacctgacagtggtggtcccatctcaccctcccggtccaagggccctggtgggaagcgacccgagcgtattcgccgcccgcagctcgcgcgcctgggcacccgggggcgctcacagtgatcgcggggccagcacaccctcacccaggacatccctttcctccccccaaccccaactccggagtggctcagagggagggaaagtagatgccggcaccctaccccgcccctcctgcccccgctgtgccgttctcggtcgtggtatcggccaggccttaccccttcctccctggcgcagctggggtcctcctccgggccaggcagagcaggcgggcatcagaagtgggggccaagcaggtgggtgagggcagggcaggagcaagcaggggagatgcagacggggcggggccaagcaggtgggtgagggcggggccaagcaggtgggcggggagggggcggggccaggcggggtaaatgcacactggaacggggccaaacaggtgggcgaggagggggcggggccaagcgggatagatgacacgagcggggctaagcaggtgggctcgggcgggggtgggggtgggggcgggggcgcaggcgggggcgggggcgcggacaggccaagccagggggtgaggcggaggcagggccaggccggtccgtggggagagggcgggccaagccggtgggcgcgggcagggacgccctgtgcgcgccggaccggcgggggcggggcgtgcaggcgggggcggggcacgccgtcccatgggaccggccctcggccactgccccctccggccccgccccgagcgcccgggctgggccggcagcggccccccgcggcggggctggcagcagtggctgcccgcactgcgcccgggcgctcgccttcgctgcagctcccggtgccgccgctcgggccggccccccggcaggccctcctcgttatggccgcggcctcctccccgcccagggccgagaggaagcgctggggttggggccgcctgccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtgtgagtatcgccaccggcgacggccggcacgaaggtgcttcctgagagctggtgtgggggagctctgtcccagcgccacctgccccgtcggagctgcgaccccggagcagaggagggaaggaagtggggaaacgcagaaacacaaactctgcactctcccttgaagttcagaggcgctgctgtgtctgggggtgcgcatcttctcgcaggcccggcgtggggagggagccggctggggaggggaccacctggagcccagaatttggctccacacctccgggagggtagtccaggtgtgaatccttctgggaagagaagcgtgctggggagcgcacccttgggtgcagtaagataactcctcaaggtcggctgagactcgaggctcaggagcccccaagagagaaggcccctgatgtccggtgccgcatctcagaccccctgaggcccaggtggactctggggcagggggctgtccaggataggaaggtgacggtggcggtgctccctgagggctcagcatgccacgggccgtccccacgggccccacattaactaattgaaccaagctcatgaaaacctggcttgatgcagagagcggagaggcacgtttgcagctctcactaagaggcagctgtgctcccggagaaagcagcgctggtagcagaggcacctggcccccctgttaccaggtggttccaattcccggtacagcgtgcctgagcagggctgggcactggatttctcagggacaggcctgggaagtcacctccgggaaggtccaggctgctctcctccatgcctgcctggggccttcccccgctgccccagtggccctacttcctggctgcccagccagcggccttttggtgtggtgccagcctctggcctgggagcctctacccagacatcccatggctgatggctgtggggctcacctgagggctgaagggtggtctccctgagcgtcctcaggtggaagcatctcctctgcctcgggcaggctcagtagagaactggctggagggcatccagaggcctgtccatgcctgctggcagctgccaccagggcctcagggcgggtgacagcaggagccaggccccaaatggcttcaagcatcgtctcaggtgagggggtggggtaggggtcgcagggctactgccttccttgctaagaggtggccttccacatcaggaaggggaagtcttacccacctccctcctcaaagatgtggttggggggtgatcttggagacttttccccaccccagctcccaagcccctgtctcctgacatgtcagtgggtgcctgagccacagccgctgctggtctgtgagaggagctggctctgctcgtggctgcaacagcgggggctcggcttggggtttgggagatatttgtgtgcagtgaccccaggggaacccagtccgatgccactgtgcaaatgtctagcagatgccaggttcacaggtgctgtgtgctggtggccacctgcctcccggaccccagactctctgagatgtccaagggtgggaagacctcctcagccagaggccaaggcaaagtgcccgcagaccccctcaattctcacttgtattcaggtttgtggacacatgcctccgggctcactgcagccacccgtgtggaggaagaggaggaagagggctcgccacgccccagaggaagtctctgcttgcacttgtgttttcttcctcatttggattgtttaggtctcggaagtttgctcagcaagagtctaccttcgcccagcctccgcagagctggcaaggcaggggtggcttctggggacaggggcaggatggcttctgtgaaggggtggccaggaaagggatgcttctgtgaagtggccagatctggggctggtcctttccagttctgggtcctgtccttgtaagacgtgtgcctggccctgggaagttgtcatgaacagcctccaacccaggtacctccatgtggggtgggactggaggtggaccctgactgggcaggacatgtggcttggtgggggcctgggagatgcgctcccaccctcagtgccctaggaggttggcaggaccagtctcttgaggggagacctggtcatagaaccaggatggcagagtagctggaggccacctgcagcctcacgaaatcaggtccagccttgcgccagtccagccttgtgttgctgtaagaagtcttggcaatggtggcggagacagggccctgtccttaggtggattgtgaaatgagaaatattgtggtttctggcctgaagacgacaagcctggccttgaagagccagggcccaggcatgtgtgcaggggggttgaggcaggagccggtgttccgctgaccctacagggctagggcgaactctcctgtgtgcgcctggggaagccagccaggatatcctgtcccctcctcggggaaccccccctccccaggagagcagctcttcctgtgttccttctggcctccctgggctggccggggtggacacggcacctgggccacaactcttgcccgcttaggcttcctgcccccaacacccccagttatctgtggttgcttgcgcccccactgggggcagctcccatcttagctgaggggatgggggtccatacagccctgctgcacccagcggtcctagctcccttgctgtgagccttagccaggggtgtggacatccaggtggcatctactctggttgctgagatgcttggagatcctggttgtggccaaggagagggatttgaggggggacctgcagtgcatggagactgcccctgtaggctctcaaacctaagtctggctcagcagcccctgttccccgctcctacagccttggctttccctgtttcccaagaactttccaggggtgttggcagaaccctcgcgggtgcgtgttaatcaacaatggagccagaagcaggtcccagaggtggatggggctgatctggctgcctccccaaaagacaaggccatgcagagccagctctcagggtgcagcacccaactttgtggactccagtgccctcctatctccaggctctggcattggagtctgaagcagctgctgggcagttgttctgcagctgggcagggaggccagaggccaaggcaggtggtggggctgggcacagaggaggacggggctctctgagccatcaggtctctttctctccatcttctttaagatctgtccacccactcctcagccctagattcccaggaaaactgggaattccttttggggcttttcccagtgctaccttctgtggggcatgagcccttggtctcatcccctggctgtctggggtcccctcacctacatcgcagacccggcccagtgtttctagatccgctcttgccaacatgtcgagtgcctaactgtggcttcgtactagttggggggaacacaggcatcccttacccctggccgtcagctggggagggggtagtccaggtggcaagagcctagagcctgggagaaagggcctccccagcctgtgtggggacaggggatcaggagggtggtagggacttgggtccttgcaggtggcctgggcagtgcctggtgggcatggatcaggtggcagggctttgtgtctgggcatggccctgtggctgggctgccttggccagggtcctgggccttctgagtctgcgtctcattctctgtggcaggctcctggtgctggcaccttcagtgcagggtgcctcggttggagggaacattcacccgtgcctggcactgaagccacagctccctgtgggcatggtgcccgcagcttgagcctacaaccctggggtactgggggcaggagggtccctttttgcttggcagttgcgaggtactggaacctttgcatataacgtgcgggctgcgttgtgtcacagggccgggtctgagggaggggctttgcggggacactcctgggtaccgatgggatgaacttccgctgggcctgaaggcctgggatgcttttgggccggccagtgcggggtcaggtggttggagccagggagctggcacgtcagctgctgctatgagttctgccacgtgccatcctggcatgtggcacgtcttgcagaggacaggaagggtgaacagctccaaacccaccctatgtgtgctccagagctggaaacaggctgtgcggagctgagtgcctttgggggcagctgagatgggcaggagcaccgtgcccaccgagggtgtcagagtgacaggggttgccaggcaactccacccgggtggctgatgcccccgtttttaaaggcgttgggtgccgagaattcccctcctgctgctaggctggtttcaagtctgctccttctgcacttgacgtccttgccagtgtgatccagagctgctcacacgagcaagcgtcctcgagtcctagggatgctgttaacagggcagcgggtccagggagctggtcctgacgcaggggtcctgatgcagcgggtccagggagctcatgccttccagcgatgggaatgccaccggtccctgtagccaaggtgcagatgcacacgtcctggtcctgagcccctgctcggccctaggcagggcccccagttccctgcattccacccgccttgtctgggaggtggacgagccctccgtagccctgacattccaaactggcttttggcccctgcgatatcttgctgtgattcaagactctgtccacgggcaagaacaacaaggctgggacaatctcatctcaggcatctgtgggaggagacagctcccaagggcggtgatgccaggagaacattccaggcccaggaagagctgagagacagcagatgcccaagacgagttgctggtgtgtggccagtgctgggagagcatggtgtcggcccggggagatgccgcagagaagcttccagaagcccaacatctgctgctggaggggagaatgaggcaatgaatatcaccatcctgggccactttgacccagaccccaaggatttggttacagaggggagggcggcagcgtctggcttcactctcgggaggtgccttggggctggccagtatgggattgctgtcactgtgggtcactccagccccggatgctcctacaccatgctctgcttgcatctggggtccctgcgggcacgtcggtgagaccgtcctggcctccacaccccttcctggtgggtagctgtctctctccagcagctcctccaaccaccatgagaaaccccagacctcacagatgcaaaattatcgtggttgacaaagggaggcggctggtgtctctggtactggctgggtgaccacagggatgccgcgtgaccctagtccagggggccgcttttacacgaggcatctgaccatgtgatagggtgtggcttctgctgcctggcccagccctcttctgggagccccacgtgggtgggtgctggctggggaggggcttctctctggggagcaggccctggctggaggtggggaagatccatgatgggacccaggtgtcttcccacttctcgaccatctcctgggaagttctaatgtttggttcagggtgtggggtccatctgagcaggcatggtgcttccagaaggatccaggttaagggtggtgggtccaagggggtgcctgagcccttctgcagaaacaccgttccccgtagagcagcagtccccaacctttttagtaccagagacctgttttatggaagaaagatttttccacccgggcagtggtgatcttgggatgaaactgttccatctcagatcatcaggtattagattctcataagaagcgtgcaacctagatcccttgtgtgcgcagttcacaataggatttgtgctcctgtgagaatctaatgccaccgctgatccaacaggaggtagagctcaggtggccgtgcacattcacctgacgctcactcactgctgtgcggcctgctccctaacaggccacggacccggggttggagaaccctgtcttagaggattgaggctcggggccatgggatcggcactgtcattgcccttggagggttctgagcactggaaggacctggctgtggtcccaggcactgggtggatggaccagcagaaaggctcccaggagggtcgtggctccctcatcggcaccggactctcaggatgagccgcctggagtctgttggcatctgcctggccgcctctggcaggaacttctcctgatggaagagccgggctggggagctgactccaggacaggcccctgcccgctctgggacctggggcctgggctctgctccccatttcgctcctccactcacagatgaggacatttgggtcgccttacagatgagacaactaggcctggccactttgctcatgccacacccagaaagccctcaggacacccagaagcccttaggatgcccagaagcccttaggatgctgtggtctcaagtgaggtggtgcactattcctggcctcaggcccagtttgtatccatgggcacccccactcccacctagcacttgccaccaggaagcaccctgaggactgtcccctttgagagttggctctcaaagccttggtctgtgcctgcgtcctggcagcgggtgagctacggctgccctcacccagagagtgcaggttccctgggggcgggggctcttagctttccctccatatctgctaaggtgcacacctttctctgctgccttccaaaatcatactctggggcgcactgaaagggtgctctgagtagctctccccggctcctggctgaacttgctccaggcagagatttgaagagattcagaaagcaggaaccacaggcagagcagctggacagggacccccacccctgtactcccttcggccctggaatgctcctctgcatggagacagcccagctgcactgggacccctcaccccaccctggggccaggggctgtgtcctcgacttccacgcagagcagcccgggcagcttagaggagggagcagaaggagctctgactgagaggggtagacccctcccagaggcatccccaccctgccccaaagaggggagcagctggagacggggcgggaacctcctctggctatatctaagcagccccgggaaccatgcgcttcaagcgtttgatcttgacgggccctgggcttggcattctattccgtgacgtctccagctgttctcttgtgaagagtcacgtctgtgctcttggctaggatggctcaaatattataaaacatacagctttgctaattaaaacagcatgacattgccttataggcaggcagatcaccaatggaacagctttttaaaaaccgcatgtaactccattgtatatgaagtttcgtaaaagaggcagcatctccaaccagtggggaacagatgggcggcttcatgcgtgctgcggggtgggtgggtggccatgtggaaagtgaccagactgcacccacttgtcacatcacacaccaggatagactcccagtgggtcagaaaaccacttgggtacctaaagaaagcgcctggaattctttaccctgagagcgaagaaacttttctatgacttgaatgctagatgcgtggaggagatttatgtgtttgaccacataagaaagaagcaaccttggctgggtgcggtggctcacgcctgtaatcccagcactttgggaggccaaggcgggcggatcaccttaggtcgggagttcgagaccagcctgaccaacgtggtgaaaccctgtctctactaaaaatacagaattagccgggcgtggtggtgcatgcctgtaatcccagctacttgggaggctgaggcaggagaatcacttgaacccgggaggtggaggttgcagtgagccgagatcacgccgttgcactccagcctgggcaataagagtgaaattccatctcagggaaaaaaaaaaatcttaatgggaaacagccaattgccaggctgggggaagatgtgatgtttcacgaagggttaatctgtttactacagaaagagtttctgaaaacagaagaaaacccacagccagcaggagatgtgaataccactcacaggacagtgacccacagggggaccttgaacatgtgagaaggtgccgccttcactcctggcgagaggggtgtcgaggaaaatgtcactgaggtcccttctggctggcagaaatcctttggcatttgctggtaggcatgcaagagggtagactctgtgaggaagggatttggcaacatctagcaaaactgtcttcactgacctgtgacccagcaaccccctccccagaacctacctgaaggcactggcaaaggcaggagaagctgcgtgtgcagggctgcttgtgaaagtactgtttggaaaactgcaaatgcccattgtaggagactggttgaatcagagatttgtggaatattatgcagctgtaaaaaaggaatgcatagatctctcttattatgaagtgattatcaggatttatttaattatttttttcaggcagggtcttgctgtgttggcaagggtggtcttgaaatcttggcctcaagcagtcctcccacctcagcctcccaaagtgcttagattacaggtatgagccaccacacctggcgtatcaggatgctttttaagtgaaaaagcacagtgaataaaaatatagcagctattcttcatctgataaaggggaggatgcaagtctggatgtatattaaaaacgaaagcaatggaagcctccaaatcttaaaagtttacctcaaaagggtggcggggggggaggtggcatatggaatcaagatgcctctgaatgtacctggttttatagatttcactttgaagccatgtaaatcaatagcttgcgtaatttttaaaaagctgttcgtaatcgcttggtgaaaaatccctaaataaatcttaaccagaaaaagtagtccctcaaaattgaaatgaaacaaatgagcctaaaaatgtgtgctgaattagtggcttaaccacccagaaggactgatttcaggtgacatatttctagcgggttactgctgaagacaaatagagctgcatgcagtggccacataattgttgtgatactatttgttatattattctaagagtgctgcatgggaattgcaggttaaggtaagtaattgtgttggtatcaccaagaatggaggttttacaaaatatgattcacatgtaaacagaattaaaaacaaaaaccgtatgatcatctcaatagatgtagaaaaaaacttttgataaaattcatcatcccttcattaaaaaaccctcaacaaaaataggcatcaaaggaacatatctcaataagagccatctatgacaaacccatggtaaatgtggtactgaatgggtaaaagcgagacacattccccttaagaataggaacaagacaaggatgcccactttcaccactcctattcaaaataatactggaggtcctagtcagaaaaatcaggcaagagaaagaaataaaaggggatccaaataggaaaagaggaactcaaatcatctcccttcaccgatgatgataagattctatacctagaaaaccctaaagagtctgccaaaagccttctggaactgtaagtgaagtctcaggatacaaaatccatgtacaaaaatcagcagctttttttttttttttgagatggagtctcactctgtcacccaggctggagtgcagtgatgagatcttggctcactgcaagctctgcctcccaggttcacaccattctcctgcctcagcctcccaagtagctgggacaacaggcgtctgccaccacgcccggctaattttttgtattttttagtagagacggggtttcaccgtgttagccaggatggtcttgatctcctgaccttgtgatccacccgccttggcctcccaaagtgctgggattcaggcttgagccaccgtgcctggccaatcagcagcattcttatacaccaatgatgttcaaactcagagccaaatcaagaatgcaattccatttataatagacacaaaaagaataaaatacccaggaatacatctaaccaaggaggtgaaagatctctacacaagagttacaaaacactgctgaaagaaatcatagatgacagaaatggaaaaacattccatgctgatgggttggaagaatcaatattgttaaaatggccatacggcccaaagcaatctacagattcaatgctattcctatcaaactaccaatgccacttttcatagaattagaaaaaactattctaacattcatgtagaaccaaaaaagagccgaaatagcaaaaaaggaactaagccagaggcatcacattacctgacttcaaactatacttcaaggctacagtagccaaaacagcatggtattggtacatagacatatagaccaatggaacagaatagagaactcagaaataaagccacacacctacagccatctgatcatcaataaaatcaacaaaaatatgccatggggaaaagacttcatattcaataatggcacagggataactggctccccatatgcagaggaatgaagtcagactcctatctatcaccatatacaaaaattaaagacagattagacgtggccaggcacagtggctcatgcctgtaatcctagcactttgggaggccaaggtgggtggatcatggggtcaggagtttgagaccagcttggccaaggtggtgaaaccccatctctactaaaaatacaaaaattagctgggtgtggtggtacgcacctgtggtcccagctacccgggaagctgaggcaggagattgcaccactgcgctccagcctgggtgacaagagcaaaactctatctcaaaacaaaaaaaaaaaaattaaaaaagattagatgtaaacattagattacaaactgaaaaaatcctggaagaaaatagtcttctcaatattggccttggcaaataatatatagctaataagtcctcaaaagcaattgcaacaaaactaaaaattcacaagtgggacctaattaaagagctgctgcacagcaagagagactgccaagggaataaacagataacctacagaatgggagaaaatattagcaaactttgaactgacaaaggcctaatattcaaagtctacaaagaattaacaaatcaacaagcaaaaaaacaaccccattaaaaagtgggcaaaagggccgggcgcggtggctcacgcctgtaatcccagcacgttgggaggccaaggtgggcagatcaccaggtcaggagatcgagaccatcctggctaacatggtgaaaccctgtctctactaaaaatccaaaaaaaaaaaaaaaaaaaaaaaattagccgggcgtgggggtgggcgcctgtagtcccagctactcgggaggctgaggcaggagaatggcgtgaacccaggagacggagcttgcagtaagccgagatcacgccactgcactccagcctgggtgacagagcaagactcggtctcaaaaaaaaaaaaaaaaaaaaaaaaaaacccaaaaaaacaaaaagtgggcaaaagatatggtagacagttcttaaaaagaagacatacaaacagtcaaacacatgaaaaaatgctcatcactgatcatcagagaaatgcaaatcaaagtcacaatgagataccatctcacgccagtcagaatggcctttgtttaaaaagtctcaaaacaacagatgctggagaggcagtagagaaaggggaacacttacaccctgttgacgggagtgtaaatgagtccagccaccatggaaggcagtttggagatttcccaaagaaccaagagttgaactaccattcgatccagcagtcccgtgtgctgagtttatacccaaagaaaaattagtcgttctaccaaaaagacatatgcacctaaacattcatggcagaaagacatgagtcaactcaggtgcctgtcaatggtagatcgaataaagcaaatgtgatatatatacaccatggaatactatgcagacgtgaaaatcatgtcctttgcagcaacatggatgcagctggaggtcgttatcctaagtgaattaatgcagaaactgaaaaccaaatactgcgtggtctcatggattataagtgagggctaaacatcaaatccatgtggacataatgatgagaacaagagacactggggaatacaagagtggggaggggggaaggggagcaaggtttgaaaagttacctgtgggtgctgtgcgcactacgtgggagaccggatcgtttgtactccaaacctcagcatcatgcaatatacctttgtgacaaacctgcacttgtacctcctgaacctattaaaaaagttgaataaaatggaaacttttggcatgggagaaaaaaaaaaaaaacagatgtaagttagaagaggttacgcaaaaatcctccatccctgcatttgaatgaggactatcagtatgcatccaggatgacgtttacttaaatatctctgtttcctggaaaggcccaggaccaaggaccactcagcagctaagagcatctctagaccccagactgtggcctctaggtaccatttccccctgaaagaaaccagggcccctggcggattccaggtctgtggcagaagatgtgcaagctaagcctggagtattcatcacagcagaaggcagggaagttatcagaggccccctagggccatgtcactggaacttgaaggggtccttgtcttcccccttctccccaagctgaagatgcagtgggtaagcctcactgaaaataacagaggaagtggatgagctgcattgatggggttcagatcccaagttcatcctgatactgaggggcaaaaccagtggactttgatttgcatttctctaaagatctgtggaggtcaatagggagaccgctcatgatgttgaatcctggcaagcaaacggagagaatctgacatgtgtcccagtcgtgattaacctgtgaactgtaactcggggaaacccagtagctgatggggttgcgtccttctttgggactcccgcagatgcctgaggcggcagtgctgctgaagtcctgccaggctccagctcctggtgaggtcagggattccgcatgcagcgtcacagctgccaacctctccaaagcagtaaaggccttcggacagtgcacagaaagtgctcccatccacaatgcttccttgcctggatggatggatggatggatggatggatggatggatggatggatggatggatcgatcgatctcaccaagcctcgtgctctaagtacaagtttactggaaatactcgggccagaggaacgcgctaaatgatactacaggaggccacttgcagaatcccagtggtgggggatggctctgtaggacacatgacctgatttcctcagtaagtcaatgaccaagaaataacggagagaaggaggaaagaatcacctatccaccaattgtgacatatggccttagttaggtcctcaataaatgatgacaaatattggattaaattacttctggtttgctgcatgttccatttttgcccatgccgcacctgccatggtgcatttctgattcccgtgcccagttgggaggctttggggttgttgggatgcttttgtgaatggcttccttccttcccaggcacaggggctttatggggctctggagcagacagaccagagtttgcacccagctcccagctggccatgttacctcaactgcaaaacgagagacggacttccttgggacgcggtggtggggacactgtggtctgtctcctctgggcgccccgtggcgcccggtggtgtgaggttaggatgtggggcgtggtgtccagggactgtgtggcctgcctggagctgggcagagacaaagcatgcatgtgacactccctgacttcaggccataacaggggcaggggtggggggcaatcagggttcctagaggacaaccccatgtagttcctcactgcagggcttggagggagcaggtgaaggcttacctgtcttaggtaatgaggagctgtgcgggtctgagacagctctggttcctttaagggtatgtaggggtcactgccagtctgtagctccctctgtgggggcaggctgtggcactgtggcgactggcagtactgacttcctctaagccaaccgggcagggacaagtcagcttgttgttccgtccacagtagagggcggccctgggggtgaacggctgaccgtgagggcgtggtccctccccccagaccaccccggaggccccctccgccctcctgcctacaaagagttccccctttgtgttgagaggcctgggtctcagaggtagatgaatggagtcgtgaaatcaggcagggattcccttctgcttaaaacccactctccttcccatgcagcacaggtggccaaaacctgcggctgggtcagaggactggtttagtaagaatttttttttttttaaatgtggttatctgctagccagaaaaggtgtgtggtttcgcagtctttcagacaaactgaatttaatagtagctgacgtgaacccctgtttctcctctaggctccagagccgcaccccagtgcaggtgtggaagctcagttcctccaaaacccagacaggccttggtgtcctgactgccacccccagggggcccctcactcgagtccttgcttgcagtgcccatgggcagcagaggtgtccggagatgcaacagggcccagacccctaccagcctgtggcccagctgggggcaggactccggggcagggtgagtccctgcgtgacctgattctctgtgggcaggccgggcagggtggctgcagggcggcggagcctgtgctgctggcctgcatttctctggctggacagatactgcgcccatatccctggtctttcaaagggctctgtggctggtggagggcagcaatgccccaagggaggagcaggtgcccaagcccccaggtggccctgcgggtacaggtacttgtttactctgtggcatcagtcctgcttcccagctcaaggccctggcctccacaggcctcctccctccctccctccctccctccttcccttttttcctgtggctccaaggcccacagtagaaaggctccagtctgtgtccatgtgttttggaggcctctcaggtacagggactgtcagcccagctgtaagtggaccttggaccgcaaatttgcatgggcccctttgccaaagccctgtgcccactgctggggaacgctggggactccgctcttgtggggcagtggggctgggtgggagcaaccccccatccgggtggctgtggccgaggcccttatgagagggtggtaggtgtgtctccacagtgggggaccagatctctctctggccccaaagactgcttcaagcctctggaggagcactttgccccaggctggggcgtgactgcttctggttgagggttgctgcctgtgcaggtggccctcttgtcggtcttgtctgctgcatgggggtgtggcctcctgtggatggcccctgtcctgggtggtactgctgcaggacctgggtttccgggggtgtccgggagtcggatgggcctcactctcctggcctccactgggtccaggagtggcgatctgtgagccaatggccgtggctgggggcagcctggggtgttgagaggccctgggcagccaccttgcctctctgagtttgtcctcatgtgtctctggggctggaactcggtgtccgacctggtgatgggtcaggtgtgatcaggtgtgtggggctcggtctgcatgtgcagggctgtttgaaggcctgtggggccatctgatgccccccttttcttcagccttggagaggatggcttctcaggccgcctcgcagcagatttgtagtctggttgctgtcgttcctgaaatagcctctgaagctctgtccgggaagggaaccttgagtgtggaggagataagcctgctgactgggtgagccggccggggcgggggtggcccctcttcccttcctcccctgcagcttccatggcctggggctgtgagaggcccgggaaggcactgtctttgcgcctgcacatgtgtgtgtctggagtgtaggatggcactggtgccgggcctggatttactcagcccagatcacggctgcttttgtttacgtggcccctgctctcacccacaactccaggtttctggctctcgggaatttgaggcctgtggctgctgtggaccctgggaaagagcctgtgcttcctgagccagtgcggggcctggcatggagtaggtaccccgggggtggacagataggcagaggaagggatgggcaggtggatggggggctgaattgtggtcagttatgggtggcgggtagatgggtggacagctggatagatgaagtactgggtgggtggagagagaaaggggtgggtggacggagggatgggcagggagagaaatggatggggcatgctgcttccagcacccactgggtgcagctgtctgctgtctgctgtcctgggggaaggtctggagagggcctctcggtgagtgtggactcagccagcctagtcccaatacagctgggatgcattgctgctccttccgccatcccagcagctgtccagagatgagacccagccccactgtgtctttctgggattcacaagaatccttccctgggctgagggggcgttgctgtgggtgtatctcatggagagccccaaggagccagggaggagccttctggtggtttgggttctggattggtgggtgctgggtgggtcttcatggctgttcttggggctgccaggcctgcaaggtagacaggcctctggacttgagtgtggctgtggacgagggcagcgtcgccatcagaggcgatgtctagggccaccccctctgacttgcctcctcctccttctgacttgcctcctctctctgacgggcctgctcctgagcttgacacctgcctgggggctcccggcgaaggccgctggtttctagaatgcaccatctcttcctggcatgacgggaaccacctgtgacattgccaccacctcgctgtaatctgggcagcagctgtcatgatcccaccatgtgccccccgtgaggcccccacctgttactgagtggcagggacgtgctcccacacccccatgcgccatcctgcaggtgctttctgctgacttctgtgtgccctggggcctgctctcttggtaggggttgaccctgcctgtgacttagacagcttggagggccaggactgaggggagggggcggtggagtgaaggggagggtgggcgctgctggcaagaaccacaggcaaagagggtgccgggggcagggaaggcctggaggtttgaggagcagaaagtagacccttgaccctccctgggctggtgagtcggggcccagcccagagtgacagggaccaaacctgggtccatgtgccgtgcccagcctggggttcaggtttcttccccgtgagctgagcagacagggagggtcttgggggaaggctgtgggcccttgggtggaagagtcttgggtgaggcccctgaactggtaagcggggcagcggcggcagggggcccagggaagtggggccagtcgggggtcctcaggggtccttcagggatatacctgctgtcagggtgtggggagtgggaagtgggggacggggtggattccaggattccgggttgtgcttggtcagagtggggaactggacgctccgtccctggctcagcctctcccggctgtgaccttgggggaccattgactttactgtgtgcctggagagcctaatccctacctgccagtgggtgacacagaaggcaggaatgcagaaggcctttcagaagttctcactggcctgcaaggtagaggctgttttctgctgaggatacatttgccccctctatcccccagatcggcggctgctcaaggagcctggtacagctgcacggaggcgcagcacccacaggacaagtggtggaatgttctggttgtccttggtgcaggtggcgggcggggctggggggctctgtagccttcctggcttcggtcccctggacaggctccacctccctcttatcgtggcccctttggcaggctgcctgccacctcaaagtcacgctgccctgggcaccctgcctcttccggggactggggctggggctggggcagctgtgtttatgggtgtactccctgtgctgggcactgcgctgagctcaacacacaggggctcggggaggtctgtgggtgcccaggccgagatgtgaaccctgagtttgtgcaactcgagtttcagagtggcggcctctgctcctcacaagacattgccctgcgagggggtcagccctgaagccggatggcccggcccccgctaccacgtggaggctccctgtaggtgcttgtgtagatgcccccgtgcggggacttgtttggctgatggatcagggggaaggttctccccacggtgtgaggcagcaccgagggctccgtgcccagcaggctcactgtcggcagttgggtctggtttgataaccgtggaccggggtgacaggccctgactctgcagagcaggactgtggaaaatggacactgatgctgcccggtggatccaggcagggccgggatgtttgcaggacccacgggacaattagaacgactgggcctgactggcacagggatgtggactacggtgcttgccatcagcagatacaagctgtacgcagtgggccgcaggcgctccctgggccggaacacatggacgtccaggtgtggaatggcccggacagcagataacaagccttcgtcgtggtcacccctgggtgtgggctgtgggttttaatcttttcatttttgctcatctgaattttctaattaaaaatatattgctttttaaaaataataaaagatcatttaaattaaaatatataagtgaggagaggctggtaagaggattctggagtccctggagtgtcttctggcatcgcatggatgagaactctgaatgaattgagtgtgatttgacctaggagagtgccggggtgggggcaggtgcactgtggtcctgggtccacatggtgctagggtcccatgggctcctggcccctggctgctgcccccacattgggccctgcaccaggcatgagtcccatgtcctgtccttggggaggcctgggggacaggagttgggggggtgggcagtgcctctgtgtggcagattccagcttctctcaggggccaggattacatggtccgtgttggactctgggatgctggtgggaagaacagtctgggcgaggaggaaagggtggctctgctgacccctcctaggtgggctggggctgaggcggatcccactgtggggagctgcccagagatggaaggagctggagtccacagggcgcttctcttctcttttcctgtgtgttaaggtagttcaaagtcctcctgcccgaggaagtaagacagcaatctctggggtcctgggcaccaactctgggcactgatgggctggtccagtgcagggagctgccccggccgcccccgtgggtgcaggccatgggctcttgtttcctttcccccatctgtaaaatgggtaacggccgctccttcaggggctgttagccacatgcttagaccgcaccgagaaaatgcagtccctccagagctcctaaccttccatgggccacaggccccttcccagaagtttttttattttttatttttttttgaagcagggtctcactctgtcgcctaggttagagtgcagtggcacagtcatcactcactgcagtgcgacctcctgggctcaagctggcaccgtgaccccttctccaaggcctgccaggctggcctccagtccaggtgtgaggccctgaggccctggctgcagctggaagctcttgggcagtgcactgtccccacagcggactgcctcctgcagccaggtggccttaggtgatcctccaaggtccagccagccaggatctgagtcaggaggaaccacggcccccaccagggctgagactcctctgagctcgtcacttgtcttggttgggtagaggcctgagagggtggacacttgcccagggtcacacagcttgtgcgtagcagagctccctgtccggcccctgccccgtgctggcccctctcacaccttgctcacgctaggtgccttgtaccagtgcctgcttgggggtggaattggagaggggaggggtgggcgccgagctctgcctcccaccagcatgcttcccagagcttcctgggagaaggtttacggaggagtggccttgtctggtgtccctctgggtagagcctgtgttccgggcaggctgggaacaatgaatggtacagatccacggctccccttgggccttggtgggctccagccatgcctcctggaaggccatttggagcctggctggcaggcaggagctgtgtgctgccaggcgggtctagatgtggttggttcctggctgcacctgccgggctcatgacctgccctgtcctttccttggggagcttggtgacggctcaggtcgactcccaggggcccgcccttcagggcctgcatgagtgttctcgggctggctatgggggcattgcttcttcctgtcctagccgggacctgcccatccacccagggggctcagggacgtttttgagttttcctgaggctttgcctagggagtgtcgctgaggaagctggaacagtgaccttcgttgttgggggaggagatgcaggcaggctgtggcccagctgccccattttgtagctggggaaactgaggcccagagtggagaagcgatctccaaaggggaggtgacacatggctgagccccgcctgatgggtgcttgctggggggagaagtcctggctgggacttcccctccccaggctggggtttgtcccctactttgcaggaggaggggggctcccagaagagagtgagttttgagggaacacagtgctgggggtcccctcctgggcctggggctgtggttcttagaggggcaaggggctggcccctgttgctggctgtggcagccacagccttctgacccttgctggcctgtcgtggagtggggttcaagatgctatcactgacatctgcccaggctcgggggcttctgtgtggtgccagccttgcccgggggcacagccatcagcaggccagaagtcctcaggagagcttgctgccaggctgctgcctggggccaggcttcagatatgctggccagccttgtccagggggcctcctgccaggtgggcagagggagagggccttcctgtcctcatgagaacagggctgagctccatgttccttagcctcccttggcctcagtcatcctatctggaaacagggatcataatagttttagtttatagagagcgagggcctggcccctgcgctcttcctctgtggtctcctctgcccgctcccagaacacctggcctcctgctctgagggccagccctgggttgcagcagtgagcatgacctggccacagtctaggggctttggggtgggtttgtgggcagctgggctgcagggggctgtgggagcctgagggagtgccttccaggggaagcccgacagatgggggcactccaggcaggggcaggaggtgacctggaggtcggaggagcaagctgtggctggagagccgggcagggttggtcagcaggtccgagggcctgggcctccctggggtgagggccagggtgcctctgcaggggtggaagtgggctgtgagggggtctgggtttatctccccattgcacagggctccatggggtgggctgagccatgagcgcccttcgtggcaccttggtgtccggcagggaggcaggggcccaggaggagggcaggactggcttcaacggtgtcggcctctacccttttggtcctcacggaggaggctgctccctcttccctggagcagccagggatggtgtggggccctggtcccctggcttgatataggcttctgcagaggatatggtgtggccgggggctcagctgagaagccaccaggagacagatacagcctcaggaagtggttttgtatctctgctgagaaccacaatccgagtcacatgggaccattgagatcacgtcagggtgcaggctggggaaggctgggagctggggtttggcaaaggcgttggggtgctcttgtgctggacaggctgctgcccaccgggcctggcccaggtgaggtgagagacacctgccccccacgtcaatgcctgggcacacgggcccagtgcacacagccagcaggcgtgcgtcttgcaatgggggctgtggggacccctttgctcccctgatcccttccctgcagacccaggccaggtggattcaaggtgtggggcagggtaggagctgggcactgctggatggcatgggccacccgcactggggctgctgtgacctccgagtccaggcactgccttccacctggttagggacagggcagggaggctgatgggctggcccagcgtggggacctgcccagtggccctgtgggtgcaggccatgtgcctctgcatttcctttaccccatctgtaaaatagggataacagcagcttcttaaagggctgttagccacgtgcttagactgtgcccggaaaatgcactgtctctcctgggctcccaacctttcacaggccacaggcccattcccagaagtttattttttatttttcgagacagggtctccctctgtcacttaggctaagagtgcagtggtgtgatcttggttcactgcagcctcgacctccctggctcaagagatcctcccgcctcagcctcctgagtagctgggactacagatgcacaccaccacgcctggctaatttttgtattttttgtagagatggggtcttgctatattgcccagtctagtctcaagctcctgagctcaagcgatctgcctgcctcagcctcccaaagtgctgggattacaggcatgcactttttttttctaagtagctttacggaggcgtgcttggcatacggtaaactgccccagtttaaagcagacagttccatgagtcctgacatttggaggccctgtgaagccagcatcagcagagtgggcacacccatcaccctcacagcgtccccctgtccccacgaccaggccactgctgccctaccatcaggcacgatggatgggcttgtgccttgtggaattttatttggatggactctggcagccaacgctggtttcgtctggcttcttttattcagcgtcatgattttgagctgtgtgtctgttgtgtgtgtcggcctgttgtttgggtagagcctactttgccgatccatgcacctgttgatggacatgtgggcggctgtatcccatttgggctctcacaaatgatactgctaggaatagctggagtctctgtgcgagcaaatgcttttgcttctcttgtgcaagcaagtggttgaactgctctgcagcccgctgggaagtggaacggctgtgtcatggggtgggtgagggcttcactttctaggacactgacaaaccgttttctaaagcagcaatccccttttgcagtccagcagctccgtgcgacagctctagttcctctgtctccttgtcaacacttggtgtggtcggtctttaattttagccaatctaacaggtgtgtcggggccctccctggcattcctggtgactcactgtgtggggtcatcttttcagctgcttagttgttgtccacatatcttctttggtaaagtgtctgtcaaattgtctgttaagaaaacgtgggtggtttttcattgaattcaagagtttttttttttttctttattttgagagagaatctcactctccgtctcccaggttgtagtgtggtggcgtgatcttgcttggctcactgcaacctctgcctcccgggttcaagtgattctcctgcctcagcctcccaagtagttgggactacagatgcccgccaccatgactggctaatatttgtattttagtagagacagggtttcaccacgttggccaggctggtctctaactcctgacctcgtgatccacctgcctcggcctcccaaagtgctgggattacaggcatgagctacggctcccggccgagatgttacatgtttctatattctggaccaagtcctctatcagatacctgctctgtgaagccttcccttatcccttgctagtccttcagttcttttaaacaattttttttttctttttttgagacggagtctcgctctgtcacccaggctggagtgcagtggcgcgatctcggctcactgcaagctccgccttccgggttcatgccattctcctgcctcagcctcccgagtagctgggactacaggcgcccgccactgtatccagctgattttttgtatttttatagagacagggtttcaccgtggtctccatctcctgacctcgtgatccgcccgcctcagcctcccaaagtgctgggattacaggcatgagccaccacgcccggcccttttaaacaacttgtttttagagctgcggtctcactctgtcgcccaggttgaagtgcttggtgctatgacggctcactgcagttccaactcctgggctcaagccatcctcccgtctcagcctcctaagtagctgggaccacaggcgcatgtcaccacgcccggctgattgttaaattttttgtagagctggggtctggctatgtcgctgacaatcaaaatgaggacttgaagcatactcctcaaatcatcgaggtttattgagccaacgtgagggcacgcccaggaaaaactccagtcacagaagcatctgtggctgctttttccaaagaggtgcgtaggaggtttcattcatatttatatgttttcttgaaaaggggaggggcatcaagtgagacaaatgattatatacttgcgagactttagttagagcccagtaaatctacattttacagaagacgtatattggaggaaagagggagcatggaagcgtatatcccagggaggcggaagaacatctcgttatctcgtctcgcctttgttctgtgcctgggaaggaagacaagccggcgtcttatgaaaaggctggtttctgttcagccctttgggaagaaaacccaatgacagttatcaagggagggggtgtgatgatacgtatccaaccgcacatccatcatggccctgaactcagcttccagggtttctctggggttccctcggccaagtggggatccactcagttaggtgggggggggggtgcttagaattttatttttatttctcattgcccagactggtctcaaaaccctggtctcgatcaatcctcccacctcagcctcccattctcttaatagtgcccttttagagagcaaacgttttgactttgatgaagtccagtttatcaacttgttcccttatggattgtgttttttggtgctctcagaaatctttccctaaaccaagggcacagattttctgttttcttccagaaattttgtagtgtcaggtttcacactgaggtggatattccttttgagttaatgtctgaccagctgggaggtgtcggtggaggctccctttctgcccgcgggttccagcacatttgctgggatggccctcctccctccacagcagagttctacccgccctcaccaccctgtatcaactcatctcatcgatatctcccaacggctggggaacaagggctgactcggctgcaatcatcctgcagccagactcggggacctaggactctgaacctccaactggtgtggcttcagggtccccaacttttcagaccccacctctgtgttgctctgcaagtggggatcagcagggctgtaccccaaatgctgcttgcttctcccgccctcctccctctccccatctgctcttggctgcacccccaaccctgacccaagtgtccttcacgctcagcaacgccacagcctctgacactccacggcactaaagtgtcaagagacccaggggacctgcgagatccatctcgccccacacaccaccaggtccccaggacttggaggatgctgatggcccagctctgggtcctaagcatggcagtatcacagcctcacaggcacatgtgtatgtgtgtgtgtgcacgtgtgtatgggtgcgtgtgcacctgtgtatatgggtgtgtgcacgtatgcacggatgtgtgtacacatgtgtatgggtgtgtgcatgggtgtgcacatgtgtatgggtgtgcatgtgtgtataggtgtgtgtatgtgtgcatgggcgtgtgtatgtgtgcatgggcgtgtgtgtacttgtgtatgggtgtgtgcatgtgattgggtgtgtgcatgtgtatataggtgtgtgtgcacgtgtatgggtgcgtgtgcacctatgtgtgtataggtgtgtgtgtttatgtatgggtgtgtgtgcacatgtgtataggtgtgtgtatgcgtgcacctatgtgtgtataggcgtgtatgtgtgcgcgtgtgtaggtgtgtgttcatatatatgggtgtgtgtgcacctatgtgtataagtgtgtgtgcacatgtgtataggtgtatgtatggttgtgtgtgtataggtatgtatgtgtgcacatgtgtgtaggtgtgtgtgttcatgtatatatgggtgtgtgtgcacctatgtgtataagtgtatgtgcacatgcgtataggtgtgtgtgttttatgtatgggtgtgtgtgcacctttgtgtgtatatgtgcatgtctatgtgtgcacatgtgtgtaggtgtgtgtgttcatgtatatatgggtgtgtgtgcacccatgtgtataagtgtatgtgcacatgtgtataggtgtgtgttttatgtgtgggtgtgtgtgcacctttgtgtgtatacgtgcatgtctgtgtgtgtttgtgggtgtgtgtgtacctatgtctgtataggtgtgtgtgtttgtgtctgggtgtgtgtgcacctatgggtgtgtgtgtgtatgcatgtgtgcatgtccctcacagggcagagctggaaagaactggagaggctgaggctggtcccttcatctcagggtgaagcacctttacccagagaaggagggtcgtggcctgggctactttgtgggctggagtcctggtctctgtcactgaaaaaagcaaggcagagcgtctgggaggggtgtcatgcggggctttctgagtcactggctgcgtgagatgtgagtaggtctgtgggatagggagctggccagggacttgagctccctgcctgctatgacctcagtcagcccctgcccattgtcaggctccttccctgtctaggggtacccagtagagctgcccagccctgccactccagcttgtttgaggaaaaagtgcaaccatgctgtgggtggaggcagatgtgattctgtcctcagaggcatgggggtgactccatggctctgagccaagttgcagctctggggcccttcttgatactccagggccccccatcaccccagcaccgagatgggcatgagcagaggggctcatggtgatggggtgggcgtggctgggagaagcctgcatatgaaggcctctgtcattggaggagactgtcccatgtccctccagatcatgtccctgagtggggagcgccttctgggcagagtggcacacagggtcccacccatctcaagtccatgggattaactcccctgtgctggaagctgcaggagctgctgcctgtggctgaggagaggccaggacgggccaaggagagcaggcaagagaaggggtggggctggcagggagggggctccattaattctgatgtcatttattgctgttcctatatttgtataataaatggaagaaaatagtggttgggggcttgctggggactcagggagggttggggacctccagggcttccattcgacctgaggcccatggtgcagtgagtcctgcctggagtcccgtccagcaggaggcaggagagctggtgtttggagatgtgaggggctgggccctcccaggtgagcgggttgggaaaggaaagggtctgtgctgggaaatccaaggggcaaggccgtttcccgtcctggtccgtcgttgagtcccctgccgtgggacagcgctcagcatggcacagacgctcagccgtgtcatgtggcttgtagagcgagggtgtgcggccggcatcatcctcagggaactctggagggactgggcctcagttggcctggcctggcgcggggctgccagccaagagccttcctccatcccattgagagccagggcaggtcctggagatggcagcctgcaggttgaagcccccgacagctgggggaggcattgctctgcacaggtagggccatggggcccgctggccagggtggccattgctcagtggcaccagctgggcagacagccgcatgcgctcaccactcgccctccacagatgggagcctgggagagccctgcctcccggaacggacatcctccttcaccaaatccgcaaaataggcctgatgccaggaacggggcactgcagggcccttgggagggaggtaagcgggcagccgggccaacctgctgcttggggaagggctgtggctggccccagcctcctaccgctggcccagtggtctctccacacatcacccagtgtggagtggttttttgtctttctttcgaaacaggctttcctcactgagggctcaccatggggctgtgctggggacactggatgtgtccagggtccgtcaagaagcgttgggggtagtcagggtctcagggaccactctgctgtcctcgagtctcctggtggtgaccagtggtgactcttgtggcgcccgggccacagctactttgttcacctcctaggagggaagagggcgagggtgagcctagggcagatgccagggcagtgaggctcacgtgggtctctttgcctgatgtgccggtgtccaggctgcagtgggcacccgagccctgtgggaagcctcctgggtctgcagctgagcaaaacagcagccgccagatgatgggccctaagtggctgcagatagcaggcaccattaaatgcagaggccatctgaggctgcaggctcagcacaggtggctttggtgcccttagggaggggcagcggtggagcccaggtctctgaaacatttatgacttcatgcgtcagctggaggctctttcaccgcccagacaaaaggcccttgcgtcagagtgttccatgtggggcgggagcttgggctgagagcttgggcccctgctcccagagaggcccagagctggggtggccacacctgctgggaatgctgctggtgggactaggttaaggcgagaaggaggtgtccatggccaggtggattagtgcagattgtgatggtgtggtggtgctcacggtgggggacttgcctatgggaacctcatcacagccccacatcgggcccttttacagatgggaaaactgaggcatggggtgcatagctagtgaggagcagagccagatgggaaccaggcgtcgacttcagagctgacctttgtgcatttgtgcattgtttgtgttgtgataaaatacacgtaacgtaaaattgacctttttaacccatgtttcatggtcttcggtttactcgcagtgctaggcgtccgacacgtctttctaattcctgaacatttccatcatccgcaagaggaaattagcagtcacccctttcccccatgcccccagctcctgacaaccacaagcccactttctgcccctggatttagctattctggatgtttcatgtgcctgaaatcatggcaaacgtggccctgtgtgtctggtttccttcaccgagcgtcctgtcttcactgtccgccgtgttataacacgcaagggaattcccttcctttctgagctgagtagtggtctgtggtgtggatggactacgtgcagctgtctctgcctttggctgttgtggctagaggctccttcctgaaagcctgatacttagaatggatttaaaaacaaattcaaatgtgtgttgcttatgaaaatcacaaaattaagtatgatgccatcaaaatgaaaaaatggctaaagattttcaagcacacacacctaaagatagcagacattccattcaaccttcatctcaaagaattagggcaaggagggcgattctaaatggctggagacatagtcagctgtgaagctgtaactttcatgaagacagtgacgtggtttgtcactgcccggatctcatcttgaattccctgtgttgtgggagggacctggtggggggtaattgaatcacggggacgagtctttcctgtgctgttctcgtaatagtgaatacgtctcataagatctgatggttttaaaaagaggcattccgctacacaagctctctcatgttttgcctgccaccatccacgtaagatgggacttggtcctccttgccttccgccatgattgtgaggcttccccagccacatggaactgtaagtccaattaaacctctttcttttgtacatttgctcagtcttgggtatgtctttatcagcagtgtgaaaacggactaatactgacaataaattaaaaactatttaaaatgcaaaggaaaatataaatttaaatcacctcttcgagtctctggtagatcaagaaaacaaaaataatctgaattattgatatagttaaattaatagatatatcaaactttgtaacttaaaagcaaaagatgtaccttttacagtgttcctggaacactcacaaacattgatcatatactagactgcaaaaacttcaagacattctaaaattaagaacctatgctggatatctctgatttcaacgtatgtttaaaatatatgttattaattacaagtttaattaatgaaagtctaaagaagaaaagtctacttagaagtaaaaacatcagcaatattactgtgtaatagatctgaacattaaaggggcatatatgcatatctgtacaccgaggcaaatttatagctacaggcattttccttttttgaaaaaagtaaatatgtaagttaaaaagttcacagtaagaaaagtgaatgtaaataagagataagaatagaaaataataggaaacaggaaaacagacttgagggttctttttgggaggtgattcttggttctttgaggaaaacaatatatatcttataatttcaatcatggaaaaaccccaagtatatatctaaatttagacatgagaaggctctttggcaatcgatttagaaaagttttgtttgtgtttttaagacagagtctcactcaatcacccaggctggagtgcagtggtgcaatcttggcttacagcaacgtctacctcccgggttcaagcgctcctcccccctcagcctcccaagtagctgggtttacgggcatgtgccaccacccctggctaactttttgtatttttagtagagacaaaggtttcattatgttggccaggctggtattgaactcctgagcacaagtgatccacccacctcggcctcccaaagtgctgggatcacaggcatgagccactgcacccagcccagtttttaatgtgacagtactttgtaaaattgtactccagtgaatttgaaaaatgttgtgagatggcttattctttgggaaaaaatgttaagtcaaaattaggaagaagtggagacaatctcagtatgtgtgagatgaatctgaaccctcatcagaacgtccacagctgacggtgaacacattggcaggtgagatatgtggagacatggcacgtggtgaaaatgcttggcaaagtgttcaaggcaggatggagataccgtatgggcattcactggacagtgttttcatcccgtatgtttgaacaatttttaatgtgggatcaaaggtaggaaatgctctttacaaagtcatcaaaaagttttttctggaaaagcctccagcccacggtgacctaggttcttcccaccattgaattaggatgccgtctgctactgagagagccagtcatgttagtggctcaatgggcagggtgcccaggttagctgtgaacaaagtgatctctctgctgcctcactagcagagagaaaagaaaactacagaccagtgatatgtacacagagagcaatgaaaatcctcattatgatggcagactaaacccatagtgtgttaaaaatgaccacacatgtaggctaggcacagtagttcatgcctgtaatcccaccactttgggaggctaaggtgggaggattgcctgagctcaggagaccagcctgggtgacatagtgagaccccatctctttttattaaaaaaaaaaaaaagaccatacatacacacatgcacacacaacagtggtaatggattataattcatgaaaaaagaatctatgcatccacagggacacacccatgtatataaacaaataagtggaagaaaggaatccagttctcacgttagaatcaacagggctggaaggccatcaaggaaaccccgtggcaggggcaggggttcaaagagctggtggttgtagtctcagtgtctcccaccaccacttactagttacaaaggaaaaagaatcactttctagaggcaaagctggcgacaccacccgagccaagtgatccaagttaacatcaccaggaatgggacaggccagcttcaccaccctccggatggacagcctcggtagcagaactcctgccaaagacacagctgtccagggtcgaatcatccggagacacagggcaaacccacatggagggagacacacacagtggcctgaatactttgaaaatgccagggccaaaaaacgtagaaggctaaataaagtaccgttcagggtgaaggggaaggaagaaatgtgatgcctaagtgggagtctatgattccactatgttatgtattagtccattttcaaattactgataaagacatacctgagactggataatttataaagggaagaggtttaattgactcacagttccacatggctggggaggcctcacaatcacagcagaagatgaaggaagaacaaaggaacatcttacatgatgacaggcaaagagataatgaaaactgagcacaaagggtttccccttataaaaccatcagatctcgtgagacttattcattaccatgagaacagcatggaggaaaccacccccatgattcaattatctcccacgaggtccctcccatgacacgtgggaattatgggagctacaattcacgatgagatttgggtggggacacagccaaaccatatcattccaccccggcccctccctaatctcatgtcctcacatttcaaaaccaatcatgccttcccaacggtgccccaaagtcttaactcatttcagcattaactcaaaaatctgcagtccaaagtctcatctgagaccaggcaagtcccttccacctatgagcctgtaaaatcaaaagcaagttagttaattcctagacacaattagggtacaggccttggataaatacacccatttgaaatgggagtaattggccaaaacgaaggggctaaaggccccatgcaagttcgaaatccagtggggcagttaaatcttaatgctccaaaatgatctccattgactccatgtctcacatctaggtcatgctgatgcaagaggtgggttcccatagtcttgagcagctctgcccctctggctttgcagggtacagcctccctcctggctgctttcacaggctggcattgagtgtctgcagcttttccaggcacatggtgcaagctgttgatggatctatcattctgggatctggaggacagtggccctcttctcacagctccactaggcagtgccccagtggggactttgcatgggggctccaaccccacttttcccttcctcactgccctagcagaggttctccatgaggaccccacccctgcagcaaacttctgcctggacatccaggcatttccatacatctctgaaatctaggcagagctttccatacctcaattcttgacttctgtgcacccacaggctcaacaccacatggaagctaccaagagttggggcttgcaccctctgaagccacagcccaagctgtaccttgacaccttttagctatggctagagcggctgggacacagggcaccaagtccctaggctgcacacagcatggaggccctgggcccagtccaggaaaccatttttgcctcctaggcctctgggcctgggatgggaggggctgctcctaaggtctctgacatgccctggagacattttccccattgtcttagtgattaacatttggcttcttgttacttatgcaaatttctgcaggctgcttgactttctcctcagaaaatgggtttttattttctatcacattttcagactgcaaattttctgaacttttatctctgtttccctttcaaaactgaatgcttttaacaacacccaagtcacctcttgaaagctttgcagcttagaaatttcttccaccaaataccctaaatcatctccctcaagttcaaagttccacaaatctctagggcagtggtaaaatactgccagtctctttgctaaaacatagcaagagtcatctttaatccacttcccaaaaagtttctcatctccatctgagaccacctcagcctggatttcattgtccatatcattatcagaattttggtcaagcccttcaacaagtttctaggaagttccagactctcccacattttcttgtcatcttctgagccctccaaactgtccaacctctgcctcttacccagttccaaagttgcttccacatttttgggtatctttacagccgcaccccactcccagtaccaatttactgtattagtccattttcatgctgctgataaagacatacctgagactgggtaatttataaagggaagaggtttaattgactcacagttccacatggctggggaggtctcacaatcatggcggaagatgaagaaagagcaaaggcacatcttacgtggcagctggcaaagagagaatgaaaacagagtgcaaggggttcccccttataaaaccatcagatctcatgagacttaattcactaccacgagaacaatatgggagaaactgcccccatggttcaattatctcccactgggtccctcccacaacacatgggaattatgggagctacagttcaagatgagatttgggtggggacacagccaaaccatatcagagttgaatcctgtctgggaagagatggctgcaatagccagtgtctgggcagctgatgatgtgagagtgtgaggtagagaactgtagtgtgcaatagagacctgtagtgtgcatgtcagtgttgtttcccgattttgacaacagtaccacatggttacagaagagaacacccttattcctaagaaatccatgaggaggcgtttagcagaaaacaggcatggtgtctccaagggctcagaaagattcaaccaaaagagggaagtctggagagggacaggatggagcaggacgggggcagtgtagaaaccgcaggcaagtctaagcagagcacgtttgggagttccttctgctattcttgcaacttctctataagtttgaaatgaaatcatataaatcgaaagttagaagagaattaccacatcatgttggatttcactcatagccacgagaacgggtggtggtctcttctgcagtgaactgatgcgatgtgtgatgtcactagttctcatccaaagcagatgacaattccagttactcctcaccagacataagaaaatgcttttagtagatcagtttttctgattgtaaagttcagaaatgttaatcagagaacgtgcagaaatttttaaagaagaaaagtaaaatgactcatcgtaccaaaagccagagatgccagcttttagtttcctgctagtctttttctcggcgtgtgtgtgtgcgcgcgtgcatgcacatgtttctacttggtctttgtgtgtgtgttaagggcgtgtacacacacagtgcagtcaggagtgagttgcacgtctacagctaggctgcttccccgaggctgtgtggccatcagccaggcgtccccaacccccaggccatgaagcactaccagtccatggcctgttaggaaccaggctgcacagcaggaggtgagtggcaggtgagcaagtgaagcttcatctgtatttacagtcactccccatcactcgcattaccgcgtgagctctgcctcctatcagatcagtggcggcattagattctcacaggggtgtgtaccctgttgcaaactatgcatgtgagggatctaggttgcctcctctttataagaatctaatgcctgatgatctgtcactgtctcccatcacccccagatgggactgtctagttgcaggaaaacaagctcagggctctcactgattctacattatggtgagttgtataattatttaattctatattacaatgtaataatagtagaaataaagtgcccaatgcaagtaatgtgcttgaatcatcccagaaccacccacaccactggtctgtggaaaaactgttttccatgaaaccagtcactggtcccaaaaaggttggggaccacggccatcggctgtttgctttatgaatttgtgcctcagtttcttcatctctgaaacgggaacgatgggagccctcacctcgtatggtggtttgaggattgaatgaactcattgtccagcacccttagcttcttgccagctcaggaagtgctgagcagggtaacccctatcactgcgtgtgtgtgtgtgtatatgtgtgtgtgtgcatacttgcctatgtgtgtctgtgcaaatacttggtaaaattgagagggtactagacaactcatttgtatcttcttaccttttgacacatggcagacatgtctcacatctgttcttcctccaaatgtgacctttcaatggctgcctggcatttcccctgtgttattgaacgtaatcaactctctattgacggctgggttatttcctaattgactgctgtaaatagcattgtgatgcaaatccttgtacactcatttttgcctggaactcaagattatttccttgggtcacatttgcaggagaagactgacaggatcaaagggttcctgcatttttatggctctgacacctttggccaaatcaccttccgggagtgttttcctaatttagcttcctactgtgctgctggacatcactgactccccccgccaacccccaccccacactgcaccacaaagctgggtattatcataaaaacactgccattatgatgaagcaaaaatagaatatccttcctcctcttagtgaggggagtatgtttatgtttgttgagctctttgtattttagccacccattcactggcccacctgcccctggtgcacctgcagcagcaagactgtcatctaggttgttggggaaaccaggagtgagtggagcacgagggtcaccctccaggaagtgacctgcaagagaatggagagagtcatggaccggcatggcgtggtaatgcatggtgcgtgtctcttagcagtaagaccttgagaaggagccaggcagggaggaatgggagggtgaaggagtgccttttgtggaggggagtcggacacagatgggatttcagcagagacctgatggaattgagggagtgggtggtgtgtgcttctgcaggaagagcacccagacagagggcatggcacatgcaaaggtcctgtgttgggaacgtgcttggtgcatgtgaagaactgtgcagggaaggtgctggagataggacgggagggccacgagggttaagatcctgagagcaatgcggggggtgtgagtgatgagggacaacatcagtcctctcttggcttctgtactttaaaaaaatcattttgttttgaagcaattttagacctacagaaaagttccacgacagtactgagagttcctgtggactcctagtattaacatcttaataacggggtgtattgaccaaaaccgacacctgatacattaccgtgaactcaactgcagatctgattcaaatcccgcgtttttctagcatccggtttctgttctgtgatccccacgttgctttcagctgccaggtctcctttcgtgtcctgcagcctgtgccagctcctcagtctctctttgtctttcgtgaccttgatgttttagataagtactgggcggctgttttgtagaacgtccctcggtttggattctctgatatgctctcatgattagatcaagattgtgcatttttggcaagaacaccgcgggagtgttgttgggtcccgaggagtccctgtggcagggctgtgtgaggtcagcatgtcttagggcgggttcatttgaccttgaccactcaggtaggagtgtgtcagctgggcttctcagctgtaaattaaccattttccgcttcataattagtaaacaccttgaggaagctacattgagacattgcagctgccttttttctcctgagattttgccccgctgattttagtgcccatcagctggttttgcttgtgacaggcaaagtctgtggtgcttgccaaatggggatttgtttatttcccactttctttctatgtttgttaatttggattcttctccaggaagagctgtcccctttgttctggttatgtatccagtggcttatgtatatcagcatggtttcatagatacttcttttgtgttatgggctataagccaatgctattattatttattttcctccatttatttatttatttagagacggagttttactcttgcacaggctggagtgcagtggcatgatctcggctcactgaaacctctgcctccggggttcaagtgattctcctgcctcagcctcctgagtagctgggattacaggcacgtaccaccacgcccaactaatattttgtatttttagtggagacggggtttcatcatgttggccaggctggtcttgaactcctaacctcaggtgatccacccgccttggcctcccaaagtgcagggattacaggtgtgagccactgcacccagcctcattatttattttcattgctcaaattgtgctggcttttgccccagaaacaaccttccattcagcttccatgcccctttggtgggccctgtcttttcttggacactgccttcctggcaccccaagatgctctgggctcagcttgtatttccttgcctcagtcttgaaatcacccacttctccaaggagccagggttccttccattggagagtggtctttagaaacccaggcctgggtgcatggtgtgctcatcgccactgtggacctgctgctctgcgcccactcggccgacggagctggggaatatgtgtatggcacccccacgtctacgcttctgtgttcatctgcagatatattcatacatgagtgggctcatactgtctccaactccagttctgccccagtggggccaattctctctctttgttgtaacacctttcttcaatagtgagaaacctggctctctcaccttcacctgctcgtccaaccccagctgcaagggaactggctccatacttgctgatgcgtgcccccatgagaagtgactgaccacccagagcctggcgcctgtgcatggcgtctgtgcacggcgcgtcttgtcttcagcctcactgcgtcccatcagtgcttttccccacggtgactttgagtatttctttacttctgtactcccttcagtgtgattatgtcattcatctgtgacatgtttagatttatctgttaggttggtattccattttgggtgtcccccgattctgattgtttttagttacttatctgggggtctgtgtgaagggaatgtaaagctgctgtgactcctggagtcagaggtgcacaaagagtgtcctcagaggagagccaggcgcccaccctgccagcccttccctccccactccatcccccacccccccaccctggacaaaaccagctcttcagcctttcatgtctctcttgcaggcctctcgcacagatgagaaaatacacgtgtgttttcctgtatcccctctttcttacaaaaagggaagcacactatcaatactcttgtagatctttaattgcggtaagatacactaatgcaaaatttaccattttaactatttttaagcacacagttcagtggcatgaagtacattgattttgttatgcaaccatcaccaccatccatttctagaattttctcatcctcccaaactgaaactccatccccattaaacaccaactcccccattctctcttccccagcccctggcacctaccatttacctttcgtccctatggatttgactaatccaggaacttcataaaagtgggatcattgagtactctatttgtcttttgtgactggcttatttcacttgggcataatgtcctgaaagttcactcatgctgtagcatgtgtcagaatttccttttccttttcaaggctgaataatattccactgtatggatagaccacattttgcttatccattcatcttttgatgaacatttgggttgcctccatgttttagctattgtgaataatgctactatgaatatgggtgtacaaatatcttttcaacgccctgctttcaattcttttgggtatatacccagaagtggaatttctggattatatggtaattatagttttaatttcttgaggaaccactatgccgttttccacagtagctaccacatcctcaccaacacttgtaatttctggggttttttaatagtagccattctagtgggtgtgcagtggtatctcattatagttttgatttacattttcttatgagtagtgatgttgagtatcttttcatgctcttattagccatttgtatatcttctttggagaatatctcctcagctcttttgcccacttcattaaattgagaggtttgtttttgctgttgagttttagaacttctctatatattctggatattaatcccttatcagatataggatttgcaaatattttctctcattctgtggggtgcctttttactccgttgatagtgtctttgtacaaaaatttttaatgttcacgaagtccaagttgtctactttttgttttgttgcctgtgcctttggtctttgtgttagtccatttagcattgctataaaggaatacctgaggctggtaatttataaagaaaagaggtttaattggcttatggttctgcaggctgtacaagaaacatggtgccagcacctgcttctggcgagagcctcaggaagcttccaatcacggcagaaggtgaagcgggagtaggtgtctcatatgatgagacagggagcaagagaaaggaggttccagtctccttttaacaaccagatcttgcatgaactcattacctaatcatggggaatctgcccctatgacccaaacagcacccaccaggccccacctccaacgctggggatcacatttcaacatgagagttggaggggacaaatatctgaactctatcaatgttatatccaagaaatcatagccaaatccaatgtcatgaagcttttgccctatgttttcttctaagatttttatagttttacgttgcacatttagatatttgatccattttgagttaatttttgtatatggtgtgaagtaagggtccagcttccctcttgcatgtggatttccagttttcccagcaccatttgttgaaaagacagtccttttctcattgaatagtcttggaaccctagtcaaaaatcatttaaccatttatgccacggtttatttctgggctgtctcatgttccattggtttatatgtctgtctttttgcctgtgtcacactgtcttgattactgtaagtttatagtaaagttttgaaatcagaaagtgttaggcttccagcttggcttttctttttcaatattgcttttggctattttaagttccttgagattccatatgaattttaggatgggtttttctatttttgcaaaaagtgtcattgggattttgagagggattgcactgaatctataaatcactttgggtagtattgatatctcaacattgtcttctaatccatgaacatgggatatgtttccatttatttgcatctttttaagtttctttcagtaatgttttgtgggttttgctgcagaagtcttttacctccttggttaagttaattcctaagtattctacttgatgctattataaattaaattgttttcttaatttcatttttagattgttcattgttagcatatagaaatgcaactgattttgcatgtttaccttagattctgtaactttgctgacttcatttattagctctaataagtttttgtggaatctttaggggtttctacatatgagattatgttatctgtgaatagaaatagttttacgtcttttttttccattctggatgccttttatttcttttaatttttttcttgccaaattgctctggctagaattttcagtacaatgttgaatagaagtggtgaaagtggtcaccctggccttattcctgaccttagagggaaaaatttcagtctcatcattatgatgttagctgtggattttcacatatggtttttattatgttaaggtagtttccttctattcctagtttgttgagagtttttaataaggatgttgaattttgtcaaatgctttttgtatcaattgagatcatgtgatcatgtgagtgttatttcttcattctgttaatatgctcttttacatggatttatttttgtatgttgaaccatccttgcattccaggactaaatctcacatggtcatgatatgtaatactttaactatgtttctgaactcagtttgctattttgttgagaattttgcatcagttttcataagggatattggtctgtagttttcttgtagtctttgtctggctttagtatcagagtaatgctctcctcatagaatgagttagaaacctttcccctcctctttaattttttgggaaagattgagaaggatgggagtttattctttaaatatttggtaggattcattggggaagccatcaggtccaggcttttctttgttgagagttttttgattactgattcaatctcctcactagttataggtccatgaagattttgtatttctttgtgatttagttttggtaggtttcgtgtttctcagaatttgtccatttcatctaggttatccaatttgttgatacacaattgttcacaatactctcttataatcctttttatttctgtagaattgatagtcatgtccctattttcacttctgatttcagtagtcttctctcttttttacttagtccatctagctaaaggtttgtcaattcttaaaatcttttcagagaagcaactttgatttaattgatttttctctattgtttttctattctctattttgttggtctctgctgtggtatttattatcttctttcttctgctagctttgggtttagttcttttgctagttccttaagtggtaaagttaggttatttactggagatctttcttgtttattaatgtaacaatttatagggagggagtggagcaagatggccaaatagaagcctccaattgtcctccccaacaggaacaccaaatttgagaactatctacacaaaaaagcaccttcataagaaccaaaattcagataagcaatcacagtatctgcttttaactttatattgctggaagaggcactgaagagggcaagagagacagtactgaatcactgacagcactgtgcctcccatcccccagctatgtggcatggagagagaatctgagagcttgggggagggaaagtgcagtgctttgggactgtccatcgagctcagtgattccctgttgccacagaaagcagaaccaggctaaattcagcccacacccagcacagagggagcatttaaaccagccctagccagaggggaatcacatatctcaggggtcagaaactgagttccagaaaaccttgccaccacgggctaaagtgctctggggttctaaataaacttgtaaggcagtctaggccacaataactgcaattcctaggcaagtcctattgctgagatgggctcagagccagtggatgtggggggcacacaacctagtgagacaccagccagggtggctaaccccaggcagcacagctcacagaaacaaaagtgactcttttcctctgcttaaagagaggagatggagcagtaaagagaacattgtcttgcatcttggataccagctcaaccacagtaggagaggacactgggcagagtcaatgggcacacatttcaggccctggctcttggacatttccagacacaccctgggccagaagggaatccactgccttggagggaaggacctagtcttgtcagaattcatcatcagctgactaaagagcccttggaccctgaacaaccagcagtgccaggtagtatcctgtgggccttgaatgagattctgaaatatactggcttcaggtaccagcttgaccacagtggggtagagcaccaaatgggctcttggggtccctgattccaggccttggctcttggacagcatttctggacctgctctaggccagaagggagcccactgacctgaaaggtgagtccacagcctagaagccttcaccacaagctgactgaagagccctcaggccttcagtggacaaccatggtagcctgacagtactgcctatgggcctgtagtggtggtggccacagggagaggctcctttgcctatggaaaggagaaggaattctgggtatgactttgtcttgtgctactactgagtgccagcttagcctctgtagtataccacaccaggtaggtttctaaggtctttgactacagacccttgctcctggatggcatctctggacccaccttggacttgggggaactcaccaccctaaagtgaaggacaaaagcctggctggctttaccatttgctaattgtagagccctggggctttgagtgaacataggtggtagccaggtagtgcttacagcgggccttgggtgaaacccagtgatgtgttggcttcaggtctgaccagcacagtcccagtggtggtggccacaggtaagcttgtgtcactcctccccaagcttcaggtggcttagcatagagagagagtccatttctttgggagaaagtaagagaagaaaacaagagtctctgcctcgtaatgcagagaattcttctggatcttatctaagaccaccaaggcagtattttttttaatatttattttttgaaacagagtttcactcttgttgccaaggctagagcgcaatggtgtgatctcagctcaccgcaacctctgtctcccgggtttaagcgattctcctgcctcagtctcctgagtagctaggattataggcatgtgccatcatgcctggctaatttttgtttgtttgtttgtttgtttgttttagtagagacagggtttctccatgttggtcaggctggtcttgaactcccgacctcaggtgatctgcccgcctcggcctcccaaagtgctgggattacaggcgtgagccactgcgcctggccccaaggcagtatttttatgagtctgcaagaaccacagtgttactgggcttgggatgctgcctaatgcagatacggcttagatcacaacacccaagtccctttgaatacctggaaagctttaccaagaaagatgggtacaaacaagcccagactgcaaaggctacaataaatacctaactctttaatgcctagacaccaatgaacaagaccatctaggaaaacatgacctgaccaaacaaactaaataaagcatcagggaccaatcctgaagaaaagagatatgtgacctttcagagagagaatttgaaatagctgttatgagaaaacttcaaattcaagataacacagcgacggaattcagaattctatcagataatttcataccgagattaaaataagaatcaagcagaaattctggagttgaaaaatgcagctgacatattgaagaatgtatcagaatctcttgataacagcattgatcaagaacaaaaaagaattagtaagcttgaagacaggatatttgtaaatacacagaggagacagaataagaacgaatgaagcatgatctagaaaatagcctcaaaagggcaaatctaagatttattgaccttaaagaggaggtagagaaagagataggggtagaaagcttattcaaagggatactaacatagaacttcccaaacctagagaaagataccaatattcaaatacaagaagattctagaataccaagcagatttaacccaaagaagactacctcaaggtatttaatagtcaaagttccaaaggtcaaggataaagaaaggatcctaaaagcagcaagaaaaaaaagacttataattgaactccattatatctggcagcagagttttcaatggaaactttatgggccagaagagagtggcaggacatatttaaggtgctgaaggaaaaaaaagaaaaaaacttttgctctagaatagtatatctggtgaaaatatccttccaacatgaaggagaaatacagaccttcccagacaaacaaaagctgaggatgtcatcaacaccagagctgtcttacaagaaatgctaaagggaattcttcaatctgaaagaaaagggtgttaataagcaacaagaaatgatgtgaaggtacaaaactcattggtaatacatacacagaaatacaaatagtattataacactgtaattatgctgtgtaaactactcatatcttaagtagaaggatgaaaagaagaactgataaataatgactacaacaacttttgtggtacaataggcagtacaataagatatagagacaaaaaaacttaaaaagcggagagacaaaagttgaagtgtagagattttttgttttactttaagttctggaatacgtgtgctgaacgtgcaggtttgttacatacgtatacagtgccatggtggtttgctgcacctatcaacccatcatctaggttttaagccctacatgcattaggtatttgtcctaatgctctccctccccttggcccccatctccccacagatcccggtgtgtgatgttcccctccctgtgtccgtgtattctcattgttcaacttccacttatgagtgagaacatatggtgtttggttttctgttcctgtgttagtttgccgagaatggtttccagcttcatccccacaaaagacatgaactcattctttttttatggctgcatattattccatggtgtatatgtgccacattttctttatccagcctatcattgatgggcatttgggttggttccaagtctttgctattgtaaatagtggtgcagtaaacatatgtgtgcatgtgtctttatagtagaatgatttataatcctttgggtatatacccagtaatgggattgctgggtcaaatggtatttctagttctagaatctagttctagaatcaccacgctgtcttccacaatggttgaactaatttacactcccaccaacagtgtaaaagcgttcctatttctccacatcctctccagcatctgttgtttcctgattttttagtgatcgccattctaactggcatgagatggtatctccttgtggttttgatttgcatttctctgatgaccagtaatgattagcttttttttccatatgtttcttggccacataaatgtcttcttttgagaagtatctgttcgtatcctttacccactttttgatggggttgtttttttcttgtaaatttaagttccttgtagattttggatattagaccttgtcagatggatagattgcaaatattttctcccattctgtaggttgcctattcactctgatgctagcttcttttactgtgcagaagctctttagtttaattagatcccatttgtcaattttggcttttgttgcaattgctcttggtgttttagtcatgaagtccttgcccatgcctatgtcctgaatggtattgcctgggtattcttctagggtttccgtggttttaggttttacatttaagtctttaatcatcttgagttaatttttatataagttgtaaggaaggggtccagttactgttttctgcatatgactagccagttttcccagcaccatttattaaatagagaatcctttccgcattgcttttttgtcaggttggtcaaagatcagatgattttaggtgagtggtgttatttctgaggtctctgttctgttccattggtttatatatctgtcttcataccagtaccatgctgttttcgttactatagccttgtagtatagtttgaagtcaggtagtgtgatgcctccagctttgttctttttacttaggattgtcttggctatatgggctcttttttggttccatatgaaatttaaagtagttttttctaattctgtgaagaaagtcaatgatagcttgatgggaatagcattgaatctataaattactttgggcagtatggccattttcatgatactgattattcctatccatgagcatggaatttttttccatttgtttgtgtcctttcctttccttcagcagtggtttgttgttctccttgaagaggtccttcacatcccttgtaagttgtattcctaggtattttcttctctttgtagcaattatgaatggggattcactcatgatttggctctctgcttgtctatttttggtgtataggaatgcttgtgaattttgcacattgattttgtatcccaagactttgctgaagttggctatcagcttaaggagtttttgggctgagacaatggggttttctaaatatacaatcatgtcatctgcaaacagagaaaatttgacttcctcttttcctatttgaatactctttattttttcgcttgccttattgtcctggccagaacttccaatactatgttgaatgggagtggtgagagagggcatccttgtcttgtgctggttttcaaagtgaatgcttccagcttttgcccgttcagtatgatattgcctgtgggtttgtcataagtagctcttgttattttgagatatgttccatcaattcctagtttattgagagtttttggcatgaagggatgttgaattttatcgaaggctttttctgcatctattgagataatcatgtggtttttgtcattggttctgtttatgtgatgtttagtgatttacatatgttgaatcagccttgcatcccagggatgaagcccacttgatcaccatggataagctttttgatgtgctgctggattcagtttgccagtattttattgaagatttttgcatcggtgctcatcagggatattggcctgaagttttctttttttgtgtgtcgctgccaaattttggtatcaggatgatgctggcctcataaaatgagttagggagggtccctctttttctactgtttggaatagtttcagaaggaatggtaccagctcctctttgtgcctctggtagaatttgggtgtgaatccgtctggtcctgggctttttttggttggcaggctattaattactgcctcaatttcagaacttgttgttggtctattcagggattcgactttttcctggtttagtcttggagggtgtatgtgtccaggaatttatccattttttctagattttctagtttatttgcatggaggtgtttttagtattctctgatggtagtttgtatttctgtgggatcagtggtgatatcccctttatcattttttattgcatctatttgattcttctctcttttcttctttgttagtctggctggcagtctattttgttaatcttttcaaaaaaccagctcctggattcattgatttttttggaagggtttttcatgtctctatctccttcagttctgctctgatcttagttatttcttgtcttctgctagcttttgaatttgtttgctcttgcttctctagttcttttaattgtgatgtttgggtgtcgatttcagatctctctagctttctgatatgggcatttagtgctataaatttgcctctaaacactgctttagctgtgtcccagaaattctggtacgttgtctctttgttttcatttgtttcaaagaatttctttatttctgccttgattttgttatttactcagtagtcattcagtagcaggttgttcaatttccatgtatctgtgtggtttttagtgagtttcttcatcctgagttctaatttgatcgtactgtgttctgagagactgtttgttatgatttccattctttggcatttgctgaggagtgttatacttccagttatgtggtcaattttagaataagtgctatgtgatgctgagaacaatgtacattctcttgatttggggtggaaagttctgtagatgtctattaggtccgcttggtccagagctgagttcaagtcctgaatatccttgttaattttctgtctcattgatctgtctaatattgacagtggagtgttaaagtctcgcactgttattgagtaggaatataagtctctttgtaggtctctaagaacttgttttatgaatctaggtgctcctgtattgggtgcatttatttaggatagttagctcttcttgttgcattgatccctttaccattatgtaatgctcttctttgtctttttttatctttcttagtttgaagtctgttttatcaaaggctaggatcttggccgggtgcagtggctcatgcctgtaatcccagcactttgggaggctgaggtggttggatcacgagatcaggagatcgagaccatcctggctaacacgatgaaaccccatctctactaaaaatacaaaaaaattagtcaggcatggtggcgggcacctgtagtcccagctactcggcaggctgaggcaggagaatggcgtgaacccgggaggtggagcttgcagcgagccaagaaagcgccactgcagtctggcctgggcaaaagagtgagactccatctcaggaaaaataaaaaataaaaaattaaattaaaaaaaatggctaggatcacaacccctgcttttttttttttttttttttttttttttgctttccattgcttggtaaatattcctccatccctttattttgagcatatgtgtgtctttgcacatgagatggatctcctgaataaagcacactgatgggccttaactctttatccagtttgccagtctgtgtcttttaattggggcatttagcccatttacatttaacgttaacattgttatgtgtgaatttggtcctgtcgtcatgatgctagctggttattctgcacattagttgatgcagtttcttcatagtgtcattggtcattattttggtgtggttttgcagtggctgatactgctttttcctttccatgtttagtgcttccttcaggagctcttgtaaggcaagcctggtggtgtcaaaatccctcagcatttgcttgtttggaaaggattttatttatcctttactcatgaagcttagtttggctggatatgaaattctgcttgaaaattcttttctttatgaatgttgaatattggctcccactctcttctggcttgtagggtttctgcagagagatttgctgttagtctgatgcacttctctttgtaggtaacctgacctttctctctggctgcccttaacgttttgtccttcatttaaaccttggagaatctgacaattatatgtcttggggttgctcttcttgaggagtatcttagtggtgttctctgtatttcctgaatttgaatgctagcctgtcttgctaggttggggaagttctcctggataatatcctgaagtgtgttttccaacttggttccattctccccgtcactttcaggtacagcaatcaattgtaggtttggtcttttcatatagtcccatatttcttggaggttttgttcgttctttttcatcattttttctctaatcttgtctgcatgccttatttcgttaagttgatcttcaatctctgatatcctttcttccacttgattcattcggctattgatacttgtgtatgcatcacaaagttctcatgctgtgtttttcagctccatgaggtcatttatgttcctctctaaactggttattctagttagcagttcctgtaaccttttatcaggttcttagcttccttgcattgggttagaacatgcttctctagctcagaggaatttgttattacccaccttctgaagcctacttctgtcaattcgtcagtctcattctccgtccagttttgtgcccttgctggagaggagatgtgatcatttggaggagaagaggcattctggtttttagaatgttcagcatttttgtgctggtttttcctcatctttgtggatttatctgcctttgctctttgaggctgatgacctttggatggggtttttgtgtggggggtcccttttgttgatgttgattttgttgctttctgtttgctagcttttcttctaagagtcaagcctgcagtcctgcaggtctgctgcagtttgctggaggtccactccagaccctgtttgcctgggtatcaccagtggaggctgcagaacagcaaagattgctgcctactccttcctctggaagctttgtcccagaagggcaccagcctgatgccaaccagagctctcctgtttgaggtgtctgttgacccctgttgggaggtcttgcctgctcaggaggcatggggctcagggacccacttgaggaggcagtctgtcccttagcagagctcatgcactgtgctgcgagaatcccccttgtcaggatcagctgctctcttcagagccagcaggcaggagagttcaagtctgctgaagctgtgcccacagccaccccttctccaggtgctctgtcccagggaaatgggagttttatctataatcccctgactggggctgctgcctttctttcagagatgccctgcccagtgaggaggaatctagagaagcagtctggcctcagctgctttgctgtgctttggtgaattctgcccagtccaagcctcccagcctccttagcactatcaggggaaaaccgcctactaaagcctcagtaataccaaatgcccctcccgccaccaagcttgagcatcccaggtcaacttcagactgctgtgctggcagtgagaatttgaagccagtggttcttagcttgctgggctccatgggagtgggacccactgagtgagaccacttggcttcctggcctcagccccctttccaggggagtaaatgattctgtcttgctggggttccaggcaccactggggtacagaaaaaactcctgcagctagttcaatgtctgtccaaacagcaactcagttttgtgcttgaaacccagggccctggtggtataggcacatgaaggagtctcctgatctgcagattgcaaaacccatgggaaaagcatagtatccaggccgggtatcacagtcccgggtatcacagatgacgggttgatgggtgcagcaactgcatgcaaactgcatgtttgcagttccctcggctgggggagggaggtctcccggctccttgcacttcccaggtgaggcgatgccccacctgcttctgtgtgccctccgtgggctgcacccactgcctaatcagtcccaatgagatgaacttggtacctcagtcagaaatgcagaaatcacccagtgttgatctcactgacagctacagactggagctcttcctattctgccatcttgccagatgtaaagtgtagaatttttgattttgtttttttgcttgtttatgcaattagtgttaagtcatcatcagtttaaaataatgagttgtaagatattttcaagcctcatggtaacctcagatctaaaacatatggcagacacacaaataaaaagcaagaaattaaagcatgccactagagaaaatcaccttcactaaaaggaagacagaagggaagtaacaaaggaagagaatatcttcaccagaaaacaaataataaaatggcaagagtgagtccttacgtatcaataataatattaaatgtaaatgggctaaccttgccaatcaaaagacagagtggttgaatggacccccgcccccacaaaaaaagacccaattatctgttgcttacaagaaacacatttcaacctataaaaatacacatagactgaaaattaagggcttgaaaaaagatattccgtgccaatagaaaccagaaaagatcaggagtagctatacttgtattaggcaaagtagagttcaagataataactataagaagagacaaagaaggtcattacatcatgataaagggatcaattcagcaagacgatataacaatttcaaagaaacatctaacttaatctgcactgtagaccaaatatacctaatagatatttacaggacatttcatccagcaattccaagagaagaatacacattctcctcagcacatagctcattctcaaggatagaccatatgttagatcacaaaacaagtcttgaaacattctaaaaaattgaaatactatcaagcatcttctctgaccagtacagaataaaactagaagttaataatgagacattttggaaactatacagacatacacatagtaattaaacaatatgctcctgaatgaccagagggtcaaggaagaaattaagaaggaaattgaaaattttattgaaataaattacaatggaaacacaacataccaaaacctgtgggatttgtttgtgtcttttttacttccttgagcagtggtttgtagttctccttgaagatatgaacagacacttctcaaaaaaaagacatttatgcagccaaaaaacatatgaaaatgtgctcatcatcactggtcattagagaaatgcaaatcaaaaccacaatgagataccatctcacaccagttagaatggcgatcattaaaaaatcaggaaacaacagatgctggagaggatgtggagaaataggaacgcttttacactgttggtgggagtgtaaattagttcaaccattgtggaagacagtgtggcaattcctcaaggatctagaacccaaataccatttgacccagtgatcccattactgggtatatacccaaaggattataaatcattgtattataaagacacatgcacacatatgtttattgcaccactattcacaatagcaaagacttggaaccaacccaaatgcccatcaatgataggctggataaagaaaatgtggcacatatacactgtgaagtactatgcagccataaaaaaagatgagtttatgttcttttcagggacacggatgaagctggaaaccatcattctcagcaaactaacacaagaacagaaaaccaaacaccacatgttctcactcataagcgggagttgaacaaggagaacacatggacacagggaggggaacatcacacaccggggtctgttggggggtggggggcaaggggagggagggaattaggagaaatacctaatgtagatgacgggttgatgggtgcagcaaaccaccatggcacgtgtatgcctatgtaacaaaactgcatgttctgcacatgtaccccagaacttataaaaatcctgtgggatacagcaaaagcagtattaagagggaagtttctagttaaaagcacctgcatcaataaagagaaaaacttcaagtaaacaacctaatgatcttaaagaacaagaaaagcaagagtaagtcaacctaaaattagtagaagaaataataaagcttagagcagaaatacatgaaattgaagtgaagaaaacaagacaaaagatcaacaaaataaaaagttggtttttttttttaaaagataaaattgacaaacctttagccagactaagaaaagaagagggaagatccaagtaactaaagtcagagacaaaaaaggagacattacaactgataccacagaaattcaaaggataattagtggctgctatgagcaactctatgccaataaattggaaaatctggaagaaatggatacattcctagacatgtgcaacctaccaagattgaaccaggaagaaatgcaaacctgaacagaccactaagcagtaatgagattgaacctgtaatttaaaaatcttccaacaaagaaaaccctgagacttgatggcctcactgctaaattctgccaaagatttcaagaactaatactaatccttctgaaactattatgaaaaatagaggaggagggaatacctccaaactcatctacaaggcccgtattaccctgttaccaaaaccagacaaagatacatcaaaaaaaaaaaaaaaaaaaggaaccacgggccaatatccctgataaatattgatgcaaaaatcctcaacaaaatactagcaaagcaaattcagcaacaccttaaaaaagatcactcttcatgaccaagtgggagttatcccaggaatgcaaggatagttcaacatatgcaaatcactttatgtgatacatcgtatcaacagaatgaaggacaaaaccacatgagcatttcaattgatgctgaaaaagcacttgataaaattccacatcccttcaacataaaaactgtcaaaaacctaggtatagaaggaacatacctcaacataataaaagccatatatgacagacccacagctagtaacatactgaatggggaaaaactgaaggcctttcctctaagacctggaacatgacaaagatgcccactttcatcactgttatttaacacagtagtggaaatcctagctagagcaatcagacaagagaagaaaataaagggcatccaagttggaaagaaagaagtcaaattatccttgtttgcagatgatgtggtcttatatttggaaaaatctaaagaccccacaaaaaaactattagaactgataaattcagtaaagttgcaggatacaaagtcaacatacaaaaatcagtagcatttctatatgccaacagtgaacaatctgaaaaacaaatcaagaaagtaatcccatttaaaatagctacaaataaaatacctaggaataaacttaaccaaagaagtgagagatctctacaatgaaaattataatacactgatgcaagaaattgaagaggacccaaaaatggtaagatatttcatgttcatggactggaagaatcaatattgttaaaatgtctgtattgtctaaagcaatctacagattcagtgcaccccctatcacaataccaatgacattcttcacagaaatagtaaaaacactcctcaaacttatatggaatcactaaagtcccagaatagtcaaagctatcctgagcaaaagaacaaaactggagggagcacattacctgagttcaaattatactacagagtcatagtaaccaaaacagtatgtactgacataaaaacagacacgtagaccaatggaacagaatagaaaacccagcaaacaaatccatatgtctacgacaaactcatttttgacaaaggtgccaagaacatgcattgggaaatggacagtctcttcaataaacgatgctgggaaaactggatgtccatatgcagaagaatgaaactagacccctatctctcaccatataaaaaaaacaaatcaaagtgaattcaagaattaaatctaagacttcaaactatgaaactactaaaaagacattggagaaactctccaggacattggagtgggcaaagactgcttgagtaatccctacaagcacaggcaaccgaagcaaaaatggacaaatgggatcacatcaagttaaaaagcttctgcacagcaaaggaaacaatgagacagcctgcagaatgggagaaaatatttgcaaagtgcccatctgacaagggactaataaccagaatatgtaaggagctcaaacaaccgcacaaggaaaacatctaataatccaattaaaagatgggcaaaagacctgaatagacatttctcgaaagaagacaaatggatgaaactggaaaccatcattctcagcaaactatcgcaaggacagaaaaccaaacaccgcatgttctcactcataggtgggaactgaacaatgagaacacatggacacaggaaggggaacatcacacactggggactgttgtggggttggggggaggggggagggatagcattaggagatatacgtaatgctaaatgacgagttaatgggtgcagcacaccaacatggcacatgtatacatatgtaacaaacctgcacattgtgcacatgtaccctaaaacttaaagtataataataataaaaaaacaaatgacaaataaataaatgaaaatgtactcaacgtcactgatcatcaaaaaaatgcaaatgaaaactataatgagatatgaccccaccctggtcaatatagcttttatccaaaagataggcaataatggatgctagtgaggatgtggaaaaaagggaatccttgtacactgttggtgggaatgtaagttactacaaccaccgtggaggacagtttcgaggttcctcaaaactaaaaatagagctacctctgatccagcagtcccactctagttatatatccagaagaaagaaaatcagtccagcagagaaggatccgcactcctgtgtttattgcagcactattcacaatagccaagatttgggagcaaactgagtgtccatcaacagatgaatggataaagaaaatgctgtgtatacacgcaacggtatactagttagccatgaaaaagaatgagaacatgtcatttgcaacaacatggatggaactggaggtcactatattaagtgaaataagccaggcacagaaagacaaactttgcatgttctcacttatttgtgggagataaagattaaaacaattgaactcgagatagagtaaaaggatggttaccagaggctgggaagggtagtgggggttgtgagggaagtagagatggttaatggaaacaaaaaaaaaatagaaaaatgattaaaacctggtatttgatagcacaacagggtgactatagtcaatgatttaattatacatttaaaaataactaaaagagagctgggcacagtggctcacagctgtaatttcagcactttgggaggccgagtcatatgactcacttaaggccaggatttggaggcctgcctggccaacatggtgaaacccccttctctacaaaaaacaggaaaattagctggacttggtggcatacacctgtaatcccagctacttgggtggccgaggcatgagaatcactcgaactcaggaggcggaggttgcagtgagctgagatcgcgccactgcactccagcctgggtaacagagtgagactgtctctaaataaataagacgaaaagagtataatgaggttgtttgtaagacaaggggtaaatgtttgaggtagtagatacccccatttacctctatgtgattattatgtactgtctgtctatgttagaatatctcatggaccccataaacctatacacctactatgtacccacaaaaagcaaaaagaaaaagagcttatgggtatcaatttttctgttagtaccgcttttgttgtgtcccagcaagttttggtacattgtcttctcatctttatttgcatttaagtattttctaatttcccttctgattttttttttttttaatttaagtcccaggacacatgtgcaggacatgcaggtttgttacgtaggtaaatgtgtgccacggtggtttgctgcacctgtcaacccatcacctaggtgttaagccctacatgcattaactatttatactgatgctctctctccctctgcccccctttttctttgattcattggttaagagtatgttgtttcatttccatacatttgttaatttttccattttacttctattattgatttctaagcttatcccattatcgttggagaagatcctttgtatgactggcatctttttgagtactttgagacttaattcgtggcctgatctctcctgggaacatttccacgtgcacttgggatgcacatgcatgctgtggtcatgggtcgagtgttctctgcatgttggttagatctaggtggcttattgtgttaagtcctctattctgtaacttatcttctgcctggttgttctattcattatagagaatgtggtactgaagtctctcaccatcattgtagaactatttctcccttcggttctgtaaatttttcctttgtgtcttttgatcgttagctgttagaggcataaatgtttacaatggttatctgtaacatcttcttgcagcctcgaacctttaagtgtgcagcgtcctcttttgtctcttgtgacctttctaggtttattataaaaccatttttggctgatgttagtgtagccactctgctttttgtgtttgccgtttgcatggaacctctttctccactctttccaccctttcactttcaatctttttgtgtctttggctctaacgcgagtctctagtagacagcatgtagctggatcatgtttatctattctgccactgccgatatcaccttttgatatacagactttacattttcataaaatttaatttgtccacgtgcttagcccctgtgatccagcaatcccactgctagttatatatccaaaaagaaagaaaatcagtccagcagggacagatccgcactcctacgtttactgcggcactgttcaccggagcctgtgccttcaatgtcgtattcaagaaatcatcctcaaatccaaagtctttctattttttcctatgtgttcctattgctttaggtcttacatttatacctttgacccatattgagttaattttttatatccagctttatttttttgcatgtagatactcagttatcccaccatcatttgtcgaaaagactatacgtgaactttttgaatttgcttttctcacgtaatagtatttcctagagaccactacatatcagttcgtggggtccttccatattcttttttacagccaccccatactttatggttggatgtgccatgcttattcaaaccctctcctatttatgggcatttaggttgttctgatattgtgcaatgataaataatgttgcaaagtatagccttatacatatgtctattgtattcttgaaacaatgttgcaaagaataactttgtaggtatggatgttcctattgttggaggtgttattttcagggtagattcctagaaatgggagtgttgggctgaaagagaagcccgtagttttgttggatgtgaccaaatttccctgcagaacggttgcacatttgcactcccccagcaatgcatgagcataccggttttttttacagttgcgccagcagcgtgctgtcacaccactttttgccaggtccatagctttgttttaatctgtatttctgtaattacattgaatttgaatgttttccctgtgtctaaaagtcatgtgtgtgtgtatttgtaaatcgtctgtcttctcatttccaacttcttccattgggtttttggttcttggtctctcaatttttaagtcatttatattgtgggaacgtttgtctggactaatgtgaattgttttcccagctggtcacttgtctttgactttgcttatggtgctttttgctatgagaaatttcgcatgtttatatcatcaaatttatcatgcttctttctactgactccggattcagggccacagttgagagctttttcctccaccgaggttaaggggaatccactgtgttttcttctggaggtttggggtcttgtcttcagcatttagctccttgtccgtttggagtttgctcttgtgcatgatctaaggtaatcttttctcagagagtggcctgagacctcttccttagaagttcaccccactggctggggccttcacgaggcccctctggcctctaagtggagcatggagtgtggggtcatcgggcaggacacgagatgcgcaggaggctgtgactgaggtggctgtgggatgggacggcgtgtttgctctagagggtttgaaggaagggtgagaagtcaggaccactgctgtagaaaacagggtttgcaggtagataaggtggcgggtgcagcgggaggaagagaaaaggatgctgctgggacccctcgcacctgggaggatgcactttctgtttctgacatgggtcagggttggggcgaaggagtccagctggggacatgttattttggaggtgtttgtgaggcagccaggtgaggtgggttgaaggcagtaagacctgcaggtgggagctctggggagagagtgcgggctgggctcacaagttaggggaggtgtcagtgtgtaaatgacatgagcgcaggggctagacagggcctcctgtagcctgggtgggtggaagggcagagggcaagggccaagtgatggcagctgtggaggctgagggcaaggaaggcaagtccgggaggttgggtgtcctgcagcctccacaggggcaatggaggaagaacaaaggactctgtgttgagccctcctgagaggttttggaactggccttgacttggtgatgtggggttatgagttttattccacacacgtatgtgggagtctgggtcttggtgggtcccagcccagtacatggaggttgggaccctgccctgaaacctctcagacacaaacacccagctcggccccacagagctggcctgggccccagcaggggtctgtgttgccttggccccacggcagtggagctggggtttcccagggatgctgctgctgaaggtgaggtttgcaaacactaggcatgcatgtttgaggtaccacaacctccaccaacccatggtggtcaccaagggtctttgggctcctgtggggaccatactggcttgtctgacttgccgttacccggcggagatatgtcttggaaagactttaggccaggagcccatcattgtcctggaacctgggcttggcagggcaagctttggggagcactgtccagacagtgccctggacactgcacctcaggtcaggacacagctcccgaggcctggctgctctgcatggggaggagtgtgggtcctgagtggagtgtcccatctgtcatgcagagagggtgatgatataaccagctgggtgttcgcacctgagaggtttcggggcagggtcccagcctccatgtacggggctgggacccaccaggacccagactcccagactagcaggtgggcttctcagagcacagagggtgtgggtgacccagatatcctgttgttgctcagagacccccagggaatccttgaagatggcagtgaccacctggcttcctctatagaaactccccgaatgggagggatgggaaagactgttgaactaagctttttaggaagaaagccatcaattcccctgctctcatacaggcttgagtagggctaaggaaatcacagttgaatgcatgctccctccacacccatgtgcctgatgcacacagcctggcccttgtgggcactggagggcaccctacagtcacagaggcaaacgaagaatgtagagctccagctggatgagggccgtggggaaggggcacagccctgggcaagggtgtgcagagtctgcatgggatttgactgagcaatctggaaggcttcctggaggaggagctattgctcagggtgaaatagaggtcttgaaattagtacaacacatgccccatactggggaatttgggggtccctgggggaaggactctgttaccaaaagcacacagcacaggttgggagagcaactatctcaaggcttttatttgctgtttcatgaaactgaaaatttaagtttttaatatcacatattatttcatgaagagtggcttcggactttggggtacggtctggtaggatcccagggccccttcccttggcatcatcattgtttcccctccatgttcaagttcagcatctctgcaccccttgcctggcaaaccccatcttcctgtccaaagccagacttggctccctttgctccagtgagtggccgttggctgggaggctgggtctgtgctgtgtggggggtgtttggtgtcctaggaggagtctctgtcctgagcagagacagaggaaggcagggcagcctgctcagaggatgagcccagctattctgggaagcaggcaggaagtggcagctccaggtccgggtgtgagggcagtagtgcaggtcgtggtcccagatggccacggaggtgtcagcgtttcactcccagcacgtcacgccacgtccctttcctctgctttgttcctcctcagctgtgaactgtctgggactgggccaggagacagtcctgggatagggaaagaaaagaggggcttccgggggtggggagcggggctgggcggctgctggctgagccaagtggactgggaggtgtggacagggaaccctggcggggccggccaatggtggcgtgatgcagcctggcttgggaaatgcccatggaggtgacaagtgacagccgggaacagacccactgccagggctgcctctctctttagatatgtcctggcatctgactttggtttcctggtgtttaaaggctaattgggatcggtcgtggtgcctcaggcctgtcaatccagtacactgggaggccaaagtgggaggattgcttgagcctaggagttcgagaccagcctgggcaacatagcaagaccccatctctaaaaaaaaaaattaaaatattaatactagctgggtgtgctggcacatacctgtggtcccaaactactcgggaggctgaggtaggagcatcacttgagcccaggagttcaaggttgcagcaagctatgatcttgccactgcactccagcctgagtgacagaacgagaccctgtgtctaaaaaaaaaaaatttttaaataaataaataaaggtttgttggacatgttagctcacgcctgcaatctcagcatttggggaggctgaggcaagtggattgcttgaggccaggagtttgagaccagcctgacctgcctgggcaacatggtgaaaccccgtctctactaaaaatacaaaaattagctgggtgtggtggctcacatctgtagtcccagctaccctggaggctgaggtgggaggatcacttgagcccaggagtagaggttgcagtgagctcagattgtgccactgcactccagtctgggtgtcagaaccaggccctttctcaaaggaacaaacaaggctaacatgttgggctttctctgcttctgggcaatgtccgtgaaattgaagccgcactggtgttgttccacccttccttccagctggtctctgaggcccaggccagatgcttctctggttagcagcagattctaggccagagcctgcctccaggtcctgggaaggctggcacgctcagatgcactcctgggcgtggccttcctccgatcacagtgtgagcgaatctccctgcccatcactctgctcccctggcccagaccaggccatgcctcagggcttctgcacgtgcagttttctctgcctgcagggtctgtccctagctctctacccgattcagatcccacaccagctcctggggcagccctcttgccctgcctctccccgagacgtcaccctttctcttttccccattggtggtggttttatgtgttcatttacggtttattttctctctccctgtgtctgttatctgtctctgcacccctggagcccagcgtggtgccaggcacacactacgtgcctcctgggttgggggcagcagggacaaaagccaggcatgggatgtggctcttgtgggatgcaccttgggtgtgactgtcacggaaaaggaggagacgtggggtggggaagggggcagcccctactgttcctggcagcagggccagaattgagagccagaggttgccactggagggcttcctggggaggcagctggcaccgcctgattcctgtttctgaatgccctctcactctcccccacccccatggaaccagaaccacctcgtcaggcccagcagcccttcagggtcagtctctgcatgggtggtaatatggcttacctgagtcctggtcagtctgtggcctgggagtccaccctccatgactagtggtttgtggcaggtgacgggtgagtggtctccatgctcccagccgctgtgtagaggtgccaacctgcccctcctgccagagctgggctcctgttgggcgggactgaggataccgagacagaaataaaactgctaaatgcatctgttgttgaataattcaatgccccatgccaggcctgttgcaaaattagccacttcctccctccaggcccatgagtgactcctggatttggtgaaagccaggcctagtggaattgtggcccggaaggttctctgggagctgggaacctccatgcaggagcccaggggagggggtgcttggccacatgcgggcccctcaatctgccctgtggagcccggcctggcctgcagccccctgtgcagggaaaaacccgcggttttccctggtggagggcacaggtcagagcgggcatggacagggcatgaggaagcagtgcagaggaagcgtgagcatttgtctcgggccagctggagaaaggaaatggggctgcttcctggagggcagagacatcaggggctgcgctgtcgggctcggcgtgcaagatttgtgtctcatcccacggttaggtgcctcccaaatgccagggcttcccatgggccatacacactcagtcgaacaagatttgcacaaaacctgggccataagctcgctgagcacttggcctgcccagccggtgacaatgagaaccgcacatgctcagccttccctggactcagggccctacgggtgctggagccggggcgggagagggccgcaggctgcccctgcctctgcatcctccccgtcgatgcctggggccactgggattggcagaaaagggatgcccccgagatgggcagccaggagaactgtctgtctcctatcccaatatgcctacctccctctctgaatccccatttccccctcatccttgcccccacacacccagatttgcaatgggacacacggccacctgggatgacaacccctcccagtcttccctcaagacaagtgtggccatgaccgcatggggccagcagggtgtgagttgaagtgtcccgcagtggcttccggggatgtgcagccctgccctgaggccctctggccgcctcttgctctctgagcagggatgtccgtgccttgggcctgaggctgagctgggctaggtccctgggtgtctggggccacactctctggtccagcctgctgttacaggggatgcctcagggccaccactggtcatggaggctgggggcgcctgcctgtctgcccgcctggagttcaggtaaacaaccccactgaggaggcacccctagccgtgggagttggcgtgtcctgctccccagggcggtctgtccccttggcgagatccttgctgtgtcagcagagggttttcctggcccagggtcttggggagcagatgatggggctttaggagctctggctctgggaaggcagtggaccctggagcagggatcttgggaggatggagagttggcggctcaggaaggaggatgctcaagccccggcctgctcactgggaagagcggtccttggaggagagagctcccgaggagaaagccatgatgctgtgctgcgctctgggccaccaggtcttgtctggggggaatcctgaccctgtgtgatgtgagtgcagggactcccccaccctccgaccaggacctttgtactctcctggccgtgtcattgcacaactccaggggccgtcactcacctgagccctctttgctcttcttggctgttccctgatatggccacgcagagactatctctaagtgtcagttctggactcagctggaaaggtttcatgacctcaagggacccatgggacttgagggtggggcagctgtttgccctgtggatcaaaggggagtgtctgggatgggatccacctgccctgccctcaaagtgctgggcagtccctcagagccatagagcctagggggtcttgggccctcttccccagggcatggcccaggcacctgctggcctgaggtccctgctgggcccaaggcatccctgccgtgttcagagttccacaggcaccagtccaccatgctggggcctactgggagagacagccacccgcctgctgtcgggagcctccatcaccagagcctgggggtgtcccagccaccctggccgctgtttctctgcctccgcaccggcctctctcctgagttccatccatccctgcaggttgggttctcctctctcctctgggatctgcacaggttgccattctctctgcctagagggggcctccacctctgagaagccctcccttattgccccttccaatgggctgggagagggaggaaggccaggtgcagaaagagaattcacctgcccggctaaagccccacctgcctatttcaaggcctctgatgccccccggcctgcaaggtgtgtgcatggggcctgtcccatgctggctcacccagctgctcagagaggcaagtggctcccgggccccacagtgacactgggggactctttgtctccatttggggggtgtgcaggtcactcctggtgccctggtcagcttccccaacctgagctgccctcagctcctggcttggccctccacggagtgggagatgcccccctcccctgccattatcgtaccttacctcgctggcggccatggaggcagtgagaagagccgagggagctggccggggcgcatttccgtgcaggacactggctgcctcccagctcactcttagcctggtcatagagcccggcagcatcttgccaggtgcctgtggtcccagatcctggggctgccccatctctggaatattgaggtgtggctggggctgatctgaggatgaatgtggctcaggttgccgggtgcccttgacgcattcccatgtcccagtggggaaaccaaggctcaaggaggccacacagcagctccatttccagggacacccagtgttctctgtagtgggtaggaggtttccctatacaggagaccaagctacagcaagaaagacttggccgggcgaggtggctcatgggcgcggtggctcacgcctgtaatcccagcactttgggaggccaaggggatcacgaggtcaggagatcaaggccatcctggctaacactgtgaaaccccatctctactaaaaatacaaaaaattagcccggcgtggtggcgggcgcctgtagtcccagctactcgggaggctgaggcaggagaatggcatgaacccgggaggcagagcttgcagtgagccgagattgcgccactgcactccagcctgggcgacagagccagactccgtctcgaaaagagacttgggctagatgtgaggagggactttcccaagtagggatgaaccctgaggacccacaccctgagccgccagtgggtcgtgttgacctggcagctccagggcacctgaggccttcgctgtccttccgcacctcgcccccttcccgagtggaggtgctctgggagctctgcctgcttcctcaagtctttcttgtttttttatgttattttattttagatttgaggagtacacatacttgtctgttacgtgcgtaatggtggggtttgggcttctcgtgcgcccatcagccggatattggacgttatactcaataggtaatttttcaaccctccccctctcaccctctccacctcccctttggagtcccagagtgacctttctccgtctttctgtccaagcatcccatctgtctagcttccactcatgagtgagaacgtgccgtgtttggttttctgtttccggtagttcacttaggatcatggtctccagatccatccgtgttgctgcaaaggacatgatttcattcacttcttggaggctttaacgcctgccctgtgtgagggagggcggagcccctggcccaggggcggggaggcctgtccacccctctcacccgtccccgaggcccctgctgcccagcaagaccaccaccctctgctccaggacagcgcagccgccatcagtgggggtgaggggacaaggctgctgggaccaggcctcgcccaggcagagcctcgccatttctggggtggggggtgcacaggtgcatctggtctgcccagcccctcctcaccctaggcaggcctctcacagagacaagacgagtgtcctagggcagatagggccacatccatggggtcacttcagtttgtcctcccggcgccttctaaatatactctctgtgggtgtcttatcacagcccagggagccaggcttggtgtggccggccctgggagcacagagccccgttcccagcagccctcggccctggggggcttgtgctctgccgggccacctgcaccctccgggccccaggagaagctcatgcctttcctgcttgcaccccagagcctggccacccctgtcctctgctgaggccctgaccacctctatgtgtgccatggctgcagtgacagcccagaccccaggggccgggcatcccacagctctcctcactgagcccctgggcctatccgcccacgcccaggccagggctcctgctggaatctccctgtggaaggccaggctgcctggatgcccaccactccaggcttacttctgggttgtagttttcggggtgcttcgaggtgctgtggggacctgtgatgctgtcagggagacccggagtccagttctcgccaaccgctcgatgctgtgtgacttgaggcaggtcccttaacctctctgagcttcctcctctcctgtgaacaaaggatgggtccacttctcaggcttctcatgaagtttagaggcgacaggaggaggtgggctttaaatggctcagtcccagcgtcccctcatgcctgggaccgctgacccaccgggattcttgggggccaccatagagcctgtttttaaaggggatgtggcggccagctctgggggcacacgttcctgtttgaattctcaatctccgggctcaaaattggcccccagaaagcctttgagatggacagggagctggaccttcccaattcggttgcccttgcttgatgtttacatgccactgttgggtgctcctgattgtgtagcgggtcccctgaaaccaacacacaggtgcagacacccacatgccatcctgccagagccctgggttctcagcaggactctttgccgggatcctcatgctacggccaccacctgattttgtcgataaagttttattaggacacagccatgcccgggccgaatattgccacagaggccacctgccccaccacgcctaggacatttcctctctggcccagaggtgtgccacggctgcactgggctcttctggtggggagggacattgttctggcccctcctgatctctcccccaccttgccacgaccccccagagtttgcctggtgtcaccgggaagcttcctggctgcccgagggtcccccagcacctgtccctctagggcctctgaagggctttgacgtgacactcgggatggcatggcagggccctcaagcacggctgtgttcaccccccaggctgctcctggaaaggagggatcagggcccaggctccacgctccgcactgaggtgtggtcgagggccctgggcgtccgggtgagatgggaatgagcccttggtaggtgccaggcggggccagccctcatccccactgcaaggcctgagcgtccaggagccccgtgcgcagctggacccatcagtccccaccctgcagggccgttgaagagggaatgcacacctgtcacctcttggtgcgggggcatccaggttcctggcgatggggatggggtgagatgcacctgatggacctccaggtgggaagctcctgggacaccctggaaggctctggtgggagacatggcattctgtctgcaccgaagggggctcagggctgagaagccctgggacgggttggatttggggcgcgttccccagggccccacgcgtgttgagtccccgctgcgtcactgtctggcctgtggcgcctcacctctctgtctggcaggactcaggcagaatggaagtaaaggcaggaccttgtcccaggacatccaggcatgtggcgtggcaaccaggtgggatggcagggtttccccctggcaggatccccacctcctgcacctgtcctgacttggtcttctggggcagcccctaagacgcttcttcagggaagagggaccggtttggccagtgggaccatggccctgggagcatatgcctgcacgtcctgcccgctcacacctgcctgctgggggggccatgcctgcgcccgcagctcacgtcagagcccaccccaggaggctcccagcgatctgtcaacctgtgctgttggcatgcagcctgggggtgaggggtggcggaacgctgcctcagtaccacgtcctgctcaaaggccacttgcgagctaggctgagcctgtggtgtgcggtgggataggaaggaaaagaacagagtctaaggagcctaactcacttccagattcacccggaggcctgcatggaggaggcggcactgagacttcattcaccgagcttgagggtttaccctaacattcattcacaccatcagtcattcagcaaacacttcacaaacgtgcatcccacgcctggcactgggccttcggagggagggaatgcagctggtgggcccctgcctggggagcccctgctctggtcggggaggcagtggtggcagtggctgcctggcggtccatgaactggtgcaagccagagccggaggcctcctgagagcctggcagggaagcccaggccagggcctccgcagaaggagggtttggggtccaggcttcatgtggggggtcttgtaacatgggagggtagacgctgccttgggacaggagagacagaggcggggggaccaggggagtgggctgcagttggggtgcaggcctggtggccccggcagggggaccagcctctggggaggtgctgcaggcacaggagttctgtgtggacccagccgaaagctggcaggaagggacctgtttcttggggttcccagtccagatctgtgttggaaaaagtgtcagctgaaaccccaagaggctggggacagccttggtcctgctgtgggacacaggtttaatctccagatggctcctggataggcgggctggcggctctgtctaacggggacagcacacttggggcttcgggagacaatgagggcagaaatcttacccaccggccacaccaagtcacccattgttgtgtcccttgggctgggatcccatggctttcaagaactttttaaagaaatgagactcagctgccgcggaacaagccacaggtaaagagtataagacagcgtgaggcatggggtggccacgggagccctgggccaaggaggcccagtctggtggggaggcgtccattcacccggagctggacggggaggaccaggctgtgggtctgtgaagcgggtgtgggatcacatccacgctccttctgtggtttgtgccctgttgtggctgccaggggaggggcttccaaggccctgccaaccagctgggcagtgtggacaatggcagacagggtgctgtgtgggggcctgaggggcaatggttggggggcagctgttgccgttctggtgagaagtggcggtccctgaagggctggggtgctagggagcctcatggacctactcccgacgtggcagctgcctgctgcagatgggccagccatgtcccgcctgtgccgggaatcaccacccccagctcccttctctccaacatgacagggttcgggtgatgccctgtgggctgaatggtgagagaggcgtccctgtgctgacaccagtgggcgtggacgtgaccctctttttaaaagaattttttcagatgcaattccattaaggatctggaggtgagaggatgaaaaggaaactctgagctttgagtacatttttaattatgttttaaaaattaagacatgaggccgggcatggtggcttacgcctgtaatcccagcactttgggagactgagttgggaggatcgcttgagcccaggaaatcgaggctgcagtgagccaggatcataccactgtcctccagcctgggtgacagaacaagactctgtctcaaaaacaaaacaaaacaaaacaaaaaaccaaaaaacaacaacaactaatatatgtttttgaccaatacctaattctgttgtttaagaattcaaaatctaccaatagtgatcataagtaatgtattaaatacttacatagtacagcaggtgttggcccccccccacaacattggtttccatccctggaagctgcaaatgtgacctgacatagaaaacacccctttgcagctgaggctgagggtcccgagaggcgtgattgcattatccagggggcccaagtccagtgacacgtgtcctcctaaaagacaggacagattcaacaaaggaggatccggccacatgctgcacagcacgggagtgatgccgccacccacccaggacgcgggagcccgcagaggctggaaggctgaaaagggccctgtcgcccccaccccccaggatgacgtatggcctgatgtggcattcctgcctcaggaccatggcaccaagtggtggcgctggggcccctggagtcggccagtctgggcacgtcccatgctgtgtctgagcctcagtgtccccatcgattggtagtgcctcctgaaccccaatccagggggcttctggggggcagcctgggaccagacgtgcctcaccagggcttctgtctcctcaccaggacttccatgatgtgacaccttccacatggggttcagagcggggaacctgtgcctagtgtccagcccagcgtggggccctcggtgtgggccagggctcacccctttgggaggggtcgggagatgcctggcccaggctccatccatgcagagccaggaagcaggtgaacctgtggggaccttggcgacctccaaaccctgctgaggctgcctgctgacagccactggtgaggggggtgacagccactggtgaggggggtgaccagctggtagctttttctgaggtgcagattcagccctggggaacagccctggcaggctgtgagacctctgcccctgggcgtccacatcccagggctctgagctcagcagccctggagccggcagccacatcagggatggagggagacctgctggtgaccagtgagtgagcaggggaagcctgtcctctccagcgcccagtgtttccttcctggggcacatgggatttggaggcatttggagtctcccaggatgacttttttttttaagcccctagaagtggtttggggtttaagcgtcaatatttaatctcttgaagttacacattcaaggccctatcctgccttcggctttaggttcgcttcacaaacccattgtctgcttatcagcctggcgaggtcccgtccccagtaggggtctttgaacattgctcgatctcattcaccagccacggggaacattttgaaccctctgatgcttgctctatgaatgttgtttgctttaaaaaaagttttttttttattgtgataaaatacacataacacacaatttaccgtcttaactctgtgtcaggtcacggcccagtggcaataggtacatttacatggttgtgcaaccgtcaccaccatccaccccaaaacttctctcccaaactgaaattctgcacccatgaaatcccactccctctccccggccccgccatcctgctctccgcaaccgtggatccgtcctccccatgtccacagatcccctctccctcggccccgctgtccgcttccctgcgacggtggatttcgctgctctgggcctttgcgcttctgtgactggcactgtgtgttatccggtgtcctcaaggtgcctctctgctcatgtccttccatgcatgatgctttcagactgacaaaactcttcaagtattaacgtaatttttaatgtttacagattcaagaaattaagcatacggtcacgagagtgcaaagttctgtgaaacgctccagtggttacacgccccggggtttcagcttcgaccctgggtgagttccatggtgcagtggcttccagctggagttctaagggcaccccttgagctgcccacgtgtctttgcacgtgaagtaggtggctctctttaaggttcctcaactttattgggaaacatctcagggttacaaaacgccccccatgggctaaagaggctgtcactcactgtgtgtggggcctgtccccgagtgggcatggaaggccagagtcccggcacagcccccacccggactggatttgcttggcgggtcacctggatcaaccaggcccatttaggagcaccactcatgggccctactgtgtgcggcagggcaggtcatggagtctccagccttcagctcgcgttagccccaggccatctgagccgtggagcccacccaggcccgctgcctgcaccccgggggagccctcccacagcgtctcgggctatgaccctggcagggttcctgcattctcctgtgttcccgggcacccggggctgagatgttgaaatgatgtcggataattcaccgggtgccttcggggctggtactcgccgtcactgctcctgaggcctatttgctgtcaaggggaacaagtaggaggttgttttctggggtgcggtgggctccccgctcatgcagctccccgccccccgcatgaccacgccctcttgggagctcgggtgggacagcattcaggggaccacatgagctgggggggggtcggtgtcttctctcccccaccccttcgctagcctgtcctgcttcccactccgagtccaaaacacgcataggattcgtcctctcccagggccttagtttcccggctctgcagagtggggggctgtgactgcctggccttggagctgaggcagagggggtggtaggtggccctgcagaggcaggaggggacacaggcaccccaggccctgagtgcctcaagggcagggaccccagctcggcacctgtgaggttcccagctccgcccgagacaagaatagataaagcggtaaataagataaaactctttttatctggagtagataaaagtaagctttgtcatataattccttctgaggctagcacggtatatcaaaatatcggaagaatcatttagccttcagaatatggcaaggctgacagccagcctggcccatgggcacctgtccccaccatctgcctggcctgcgggggaacgttcctcagcccctgctggctcccaacccccgggcctggagccctgtcttctgcctcagccgcgattccactgcacgggactttcccaggcacctctgcccaggtagttggggtggacgcccacttgggtgcacactctgtgggggctggtccaggaccacccatgtgcagtcttccctggccacatcctgtattctcccgcaacgcccagtcaagaatcttcctgctgcagtaactccacatatctgagccagctgtgtctcctgagcacaggacatgggcaggagaggcccctgcagctggaatccgcgccatgaagcccaggcgcgtggtatttgcagccagtcaccaagttttcaagccctcacctgcggcctgtgagtgcccaccctgcacatggtgctaaccagcatccatcactgctttcttttttaatttaatttaatttttttttttttgtggtggagtcttgctctgtcacccaggctggagtgcagtggcgcgatctcggctcactgcaacctccacctccctggttcaagcaatccccctgcctcaatctcctgagtggctgggattacaggagcacaccaccacccacgcccagttaattttttcatatttttagtagagacggggtttcaccatgttggccagactggtctcgaactcctgtcctcaggcaatcctcccgcctcggcctcccaaagtgctgggattgcaggtgtgagccgccgcgcccggccccaccactgctttctatgctgtggccgaggtcaccaactgccactgtgatggacggctgtcacccaaacagcacgagaatcgaaaagccgtgatggcagatgcagaaggcagcgtcgcctgtggtcttttagaagggcagctgtgaagtggggttatctcagcttccacattgcatcacggtgcccctgtgaagggcagaggagctgcaggtaattctgttcgctcgcctctgccttggaggaagtttacagttttttttttttttttttttgaaagtttaaagctttcaacctgggcctggaggctgcagggtcagcagacctgggtcctgcccatggcccccttccctcctcaggcctccatttgctcatctgagagtggggggagtgcagcgccttccgtgcaggtcactgagaggctggggcagtggcgtggattcgggtgcatgactcgcagacatggctgtcgcttggctgaacggtggcccctgaggtgtctgtgtccttgtcctgtgaacaagttaggttgtgtggccaaaggggctttgcagggtgactgagggatggctcgtgagaggggaggttgtcctgggttacccgggtgagccctcactgtgattgtgaggattcttctaagagaagcaggaggatctgagttggaggaagagacgggaggatggaagccaggctcggcgacgggaaagctgctgtgccaccctcaccgcagccctatccctgctcacgtgcaccaagaccagagcctggcaagtcgtctcataccgagggtcaaaggggcccagggcccagcctccagggaccccagccatgccgggtcagggaaccaggctgcagtcctgtgtctcctcctcagtttaccccaattgtgacctcagaagcccttggagcctcagtttccctacttgtagcatgtgtttgatgatagtgtggcagtgatgtcacagtctggcagggtctcgtgggggtctgtgttactgtctgcaaagcactggctgggccagtggtcagtgagcaggggcgtgggtagcgggcagtggcctgcagtccccaggagcacttcctgttgctgaacagacagcaacttagtggatccttcccagggcccctggtgggtggtgggttttgccacatctttgcagtagacagcactggcagcttccggcttatccaaggcctcagggtgaagtcgacgctcgctgctgattccctgctggacgtcaggtgacacttccctccacagcctgggaagaagcacctgtgggccacttctttgtgttgataaggaaactgaggcaggggagctgcctgggtcaccagtgggcactgcatctccatgtgcagatggtgccctggccctctctgcacgccgtgggcctggggagcaggcaggtggcatcttctgccccgggcagcccggctctgcttcctcgtggctgagccaggctgtgtctaatctcacttccctgctcactgcaaatcaaaacaaacagacgtccaggaggattaagtgtggcagtcatggcggagggagccctggtagggtggagagagccaacagttgcaccagcaaggggcagagacccagcccagccctgggggctgcagggtgtggggacagggcctgcagcttggcacaaagactcttctaagaacctggagggaaccctgctccggcagtgggcagcatgctgtgtgcaaggtgagccagtctgagcccattcccagtgcccggaatggtgcccagtgcagatgggcactcacccttccaaccaacctttgcttgtgtccccgtgagatccacagattcaccctacggagggctccccacagggttggcccggaggctccagctgtgtctgttgaacaaattactctgcatccaccgcgtgctagcgctgtgcggattatagtcccagagacagatgagagcaggggtggtcagtgtaggagcacccagagggagcctggcagggcctggacatcctgtccaagctggccaggaggagtcctcagagccaaagcagtgtggagggtgggggtgcagagagcgtccctggctggaagcaccgcgtttgcaaatgccaggcagcttatgcagccagcgctttgggcaggcgggagtcagggggactgaggcccaaggaggggtagggctgcatgccagccttccaggtgctcctgggaaccacgtggctgatcagacttgtgctttgggtcgaatgtcccagtgggggagtaacctcagggagcagaggaagggtcatggtggtggggatgaagcagcagcattggggcttagagattaaatgaaggaagtcccacggggctgatcacctactgtgcaccaggctgcgtcccgggcatggactgcagcccacagccccactcttggggtgctcatggtctagggggtggacaacagactctggtcccagcgatgatgcttgagtataaaggacacagttggggtgttgtgggggccagggtcagacatcagagctggcctctgcctatgagacagggcccgctggcaggaccctcaagctgggcttttaggctgggcagcagcaggtgcacgggccctgaggtgggccgggctgggcacagtcaggactggcaacaagggccgggaggagctggggtgatctggggccatcgtggtgtaaatactggggcacgacatggagggttcactgactggctgggtgtgtgggctgggggcgccgagggtggaggtgggcactgtggtcagggggagatgaggatggatgggcagggtgcagacaggggctggctgggttcggctctgcaggtagagctgaccagtgtggcagggacagggtgtcggtgaggcaggtggctgaggaaatggtagctgcaggttttggccccagtcccagcagcgggactatggctgtggggagggaggaacccagggagggggcctgagcaggtctttggctgagtgagccctcaagggcctttgggtagggctaccagaggccaggaaaggattgtcctgtccacaggagcttggggaagggggtggggggccagagccccaccttccccagaaacctccgtgcagcaggaggatgagccgaggcaggctgtgctgggaggtagcctgtttgttgtgggctctgggggcctggggagggtgggctgggctgtccacatctggacaggtggaagaggatgggttctgggtggggctgacttcaggaggctggatgagaggcaatgcagggggccttctggctgtcctggggtgggttagaagccactcaggatggcaggatctcagggagcggagggagcctggggcaccctatgccaggcagaggatctatgccggggcccccagggtctgtgtgtggctttctctgtttgtgtctcccctggccctgggggccatgtggccatctcctggctctccggtcgctgaggatccacgggggtccctggagtctccggagcccgtgggaatccccctagaggcgggaggaaggccgggcgggccctggagggtacgtttgcagtggcagcagctccctatctttatggttccggcgatcagagaaggcggcccgtcttttctctgcgggcccacaggcccagaacgttggccccagggtggggctctgtgcgccttccctttcatgagttctgtggctcggcctcggggccttggaaaggaggaagtgaaactggaggagagcggcccacagcctgccgcctggaggctcctctgggaagcagacgcttggtgcaggtgtcaggacccccacctggcgggctggcttctgtgctgtgaccaccaacacccctgccctgggccctgaactcctggacagggggcgttgactgctctctggaagtgatttgtaaaatcagctttgtagagacgtaattacacactgcagttcatttgtggctctagggccctaagtggctctagaatgttcagagttgtgtagccaccaccaccatccacatccagaacgtttaattaccccaaaagaaaaccccacgcccacagcagtcccgccctggggcagccaccagcctgctttctgtttctgtggctctggctgtccagggcgtaaccacactgcaggtggtcagcaggtggtcacctgtctgtgtctggccttggcgccatgtttctcggacccatccacgtggcagcatgtgttggtgcttcgtcccttcccgtggcgggacggcatccctcgtgcggacctacctctagtgtgtgcttaccagctaatggatgactgggttttcgaagcactgtctgttcctacctgggggcggggctgaggccaggggcccctccactccccaggtgcatctgtgggatgggcagaggccgtgatgctgactgccgtgtccctgtcttgcagcttcctcatcgtcctggtctgcctcatcttcagcgtgctgtccaccatcgagcagtatgccgccctggccacggggactctcttctggatggtacgtagcatctgagggcatggctggatgtcatggctgccttggaagctggcatctccctggcgctgggccccataaggtggggggcagagccactcccagccccttgcccacacattggtcctgccctgatacagggggcacctccccagcccccacacttgccaagtgacttgggatgtatgtgccacaggcgagggggaccaaggactgaggggaacctggagctggtggtctgaaagggcttcctggaggaggggcttccaggctgggctggaaggaaggaaggaggaggtagggtagagctggtgtggccagcaaaggcctgcccgagccttcgtgtccctggggtctgggtgactctgttcctgggttatggctggcacacaggccctgctggtgtcccagcagcagcccccaccccaggcacctggatggtcccttccattggcctgagcggtgtctgtgccatttctgccaggcaggtgctgagagcagggcagggcaggctcatagcctggtgggaaaccccaaagttgatctggccgtgaggctgcctggaaggtggggtgcagggggccagctgtgtctggagcccacggggtccccacggaagccacctgaatgtgggccgtgagcagcaggactctggcaggactgggtctagcacctctccgtggccaggcttttgtgttttcctgtcttgtcgtggaatagttctagtatctacaaaggaagagagtgtcacgactcagctcccggcatgcacaggcagatctgggctggtttcatgctgctttctggcactgtgtcttcctggccaggggagcccgtccctccggggtccagagtcctctcgcgatggcctcggcagtggtatccgtctcatttctagggagtccgttttacctttcctttgttgcttctggaccttgagccatagctggaagaactcacctgtggtttcctccagccctgaccaggttaactgtgtgtgctccatggtggctgggagtttcctgggtaagtggtgtgaggcacaggcctgctgtcactcttccctcgtcttcccagttctcccagcactatgttttccacagtccatctgtcctgcctgactggaggggccgtcttctctgtaaaccagacgtccagaggcagtaggaagggtctgctttggggtttttctattctgtcccactggtctcctggacttttcctttaccagggccctactgacttggtggtcccggtactaaagtcaatttcatgatgtcactttgtgcctcggcagggctttctttttcgggggtttcctggtggcgcttgcagccttgcttttcccagtgaacgttgccatcaccttatccagccccgggaagaaactcgaaggccgcgggtgaataaactgggggagactgacatctcggtggtctccaggagcatggtgtgtgtgtttatgggcagcattttatggtttcgttatgtagattgcaggcagtttaagtctattcctcatcataataatattgagagaataagttgttattgttgccatcacatagggagtttctagtctatcatgttttccaggcactttcctggcgtctgcgaaagctgttaatttctgctacagcctgtggtcctgctacttctcgtgactgtggtcgtagaagtttttccctctgtcctttgcatcttttgcgtttccagataagggatgcctgccaggagggcagattgctgcttgggtctgtccagagctgggggtggtacctgcggccagcggggccctcctggcttctgtgggcgggccggctgccaggcggggggtgcgcacctcccgtgctcaggaagggtccttcaggtccgatgcctggcgtggttttacggtgaccatgtggattctggtcaggggtctttcctgcttctgtgaggtgctcctgtcagtgaggggccccccttgccttcctggaataaacccccttggtcctggcgtgtgagtttcatgtcctatcacattgtactctcatgctttgttcagacttttgcactgccctgtgaagtggggtgtgtgtgtcatcttgtggtgccatcttggttggggtgaggccgtccttcccccacagggcgatgtccaatacccttggcagcatgggcctcatgttttatggggtccccaaggtacctgcccaggatccccaagtcctcctcacccaccacagacctggctctcagatgagcacccagccaagtctctggccatgtctagcaggaggatgttctgccccggccaactgacagggttggctcaactgcaggagtgggcacggcatgtcctttgctggttctgccatggggcgggtctgtggggggtccctgacctggtagttgtccctggagggcctggggccaaggatgccagtggttcccaggctgtgagagccgcgctgccaaacattcccctggagagtctccgtgtgaggccctttgtacctctgcaggtgtgtgtacatgtgtgtatgtgagtgcccacatgcacgggaatgtgtacacgcatgtgcgtgtttatgggtgagctgtgtgcttaagtgtgcatctgtatctgagtattatgtaagtgtgcatacacatgagcacgtggggactttcacgcatgtttggctctgtttcaatgtgtgtacatgtgtgcacatgtgtatctgagcgtgtacatgtgtgaatgtggccacatataggcacattgtagtgtgcgcctgtgagcatgtattgtatgtttatgcatggctgtgttgtgtgtatttatgtatagctatgtgtcgctgcgtgtgtgtacctatgtgtatgtacgtgtgttcatgcctgtgctgtgtgtgagacgtgagatcctgcctgtcccgtccctcacgtactaacctggatctaggtggttagcccctcgcccccaggtggcctgggacttgcctggttttaaatggagccccggtgctaacgtgagcccacccaggtgctcctgcccagccagggctgtctgtcagcaccacagcgtccaagttcaggtcctcacttcctaggtggttatctcccaggcagctgggagggcgaagcctggagaagcctgcacccaggccggccctgcagggaccttcagacgtgccctgggctccacatgcccgtctgcagctcgagaattagacgtgttctgggctccacatgcccgtctgcagctcgagaattagacgtgccctgggctccacatgcccgtctgcagctcgagaattagacgtgccctgggcttcatgtgcccgtctgcagccctagaatcaccagcagcaccccaaggcccccatgcggcatctaaaccaggcaggggacaggggcatggagcagaccaggtagggttgctccctaggatgcagccctgcccaggcaggagggcagaccctacacagtgctgagctgtgcccccagggaagcctccaagatggtcctcatcccagcagccctgcccactgtctgcgcatccctggggtctgtgcgccacctggtggctatttgctgaactgtggccacaaacccctggtcagcaggaaccggccctttcactgccctgcagctccctctcctccggggtggcatggcagagaagcagcccgtggccccaagcatagagccccctttctgctgtagtcccccttgcagtcccctctgccttttccactgcttggaaggcagagagaccctggccgcctcccttgtccctttatctgtcatgccagctgcctccctgccacaccttgcgtctcaccaggcaaccctgcaaacagcagctggggaggactttctaagacaaaaacctgatcattccagaagctccctgtgacgtttaggctacattccccaaggtggtgccacgttcaggcccatcacctgtaacactacccaccccacctcacccagcctgggctcactcactccaggccaagccttggacattcctggctgccccagggcctttgcaagccctcttctctggacctggctgtcctcgggagtgtcagcactcagcctcttgtcaggtttcaggcctctgcttggcactatcctgcacaccatccccgccgacctgccctgttctgggttcatggggctctgggaggctcacaagcatctgtctgcctcaggccattccacactccctgagggtgggaccccgtggctgcgctaaccccacaagctctgcatggcgcttcctggccgtgcatgtccctccctgcatcaaatgcataggccagagttgcccaacgaggacgacccagcttggtatgtgctcccggcttcagctgcccctgagtgatggagacaccctcccactcgccttgccacacttcccagcagtctctcgaagcactggccgcgtggaaacaaatccttcaaggggatttgagggtccaactgtcactcagtcatggccatggtgggggcacgttggggacacagcagagagtgaggcagccgtgggcctggccttgacaggcggatgtacagacacatcagggccgagactgaggcgtgggctctgggtggggagacagtgaccacttgcttggaggagggggcgctcaggtgggaggggcacagtgagaaggaggtaagctggtgctggcggggcaggcagggacccctcccagggctcacagcttccagcggacagcaggcacagggctgtggggatcagagcacaggcagaagtcacctgacagcaggttcccgaggcttcaggcctggaggagtgaggacggctgttgggttcttgattccagcagagggaggctgtgcagggttgcaggaaggacggttgggggcgcttcggggaggtacgagaagcaaaggtgtttgcggcccttggggccaggcggcgggaaggcctgtagacgccagagggcgctcgtgctacatgcaactcaggagctgctggcacccgccaaggagtgctgagcgcggggagcccaaaccacagccttggggaacccaggaggggccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcactgctaaggaaaccccagcgcggcctcggagggattaggcattctgctgaaccagggatatgcggtgggcctgaaaaagccatttcgggaggaatctggtctcggctggggtccggccggcaccgtgaacaccacgtgaacaccacgtcggaaatctgctgggcagggagatttcctcaaggcctcccagggaggagagccacttcctgggctgcaaagagggccccaacctggcttctgaattcagagggggctgtgtgtgcacgtgtgtacgtacgtgcatgtgcacgtctgtgtacccatgtctgtggaagtggcacacgtgtgcatgtgtgcactcagtgtacgtgtgcgtgcctgtgggtagctccgtgcgcacatgcgtacacatatgcctggtgtgtgtgtgcacacgtgtgtctgacgtgtgtgtgctttgcgtgttcttgcctgggaaggagttcccggtttgggtggctctcctgtttcttgccgaggccagctgctgctagaaactggccccctgctctctgcagtaagagaccctgccctggcccaggtgagggcctggcttttgtctccaggatcacagcttttgtcaaactccacacaaagagagaggcactcaaaagcacaacacaaacacggctagtccgcgcctttggtggtgaacataccagggaattgtcctgcaatgcctgtggttaaaaaaccccgtgagctgcggccccggaggcctaggggatgaggtcatcgctgcggcttcctcccctctgctgaggctccctccgccccgcccggtggcccacccctcccgccagctgcagcctccactgcctgggtttctgctgcgccttcagcacacagcgaggcctcagtttccctcccagctcagagcaaggcctcagtttccctcccagcagcaaagtgagaccctgtagggagtctctgggcctccgtgacggccctgggcggccctctctgtggaacaaggtcgggtcctgtcctcagcgccctggcctccacttgctcagggcgcccgcaggcccgcaggtcctcacctggtgtttttcacctgggacccgcagctgctctgatgaggagcctgctctgcgcacggcctggggcggtttcccgcagcaccatttctgccgctgccgggaaaagacgcagagcaaaggcacctttgcccaggttggggaaccagtgggtgactcaggattttcctccacccaccccgaggtctgactccctctgcagctgccgcccgctgagggttgtcttcctccctgcctgcctcgccctgcctggtgagctcctatgggtctgacgaagccccgtcctgcacacttgcttcgggggcaactccccactagactggttgcccagggacgggggtacccactccctcctcagggctgcagggtgctctgggaagagttgtgtccctctgtgggcctgtgggctcacttgcctttttgtccctgtcacttgggagctacccagctaagaccggtccccaccacccaggccactctgaggcttcagaacgcggtcgtcttctccctggcagggttgtttccgcctgcatttgttcagccagcaaatctttattaagcacctactgtgtgccaggatctatgtgcaagcagcccatgggctcatgaaaggcagagctggactgagattccgcacccctgggatcctcactgcagggccctgtgtatgtgcgggctggagccctggttcctgtctgcactgagcccctggagctaggcccagaggacttgacagatgtgggccctctgtctgcacagcccccagggcacggggtggcctgcagctctgcccagccagacttcaggtcactgccccatgagcctgtaggagaaacttctcactcatctgtcctgagacctgcctggagcccaccccagggagacagaggctctcggagcctgttcagggtgaaaggacgctagacactggcctgcaggctttgggcgggtaagggtagcgaaggtgaaagtggaccaggggcaggtggagcagggtaggcccaagtgtctgtctggggcagctggggacacccaggtgggctgaacttcagctgccacccagcttcagctgccaaggctcctcccgggtcagggtcgacccctgatgtcccggcaagagttccaagaacaaaggctcagaatccaccaagcggaacttgaagccactgccctgtggggacaggagaagtgacttggccggctctccggagcccagtgttgatcactgaggaccaccggatacaagtccctcctgccttcccctttagtgacactgaagctgttgaaatccccatccaccaggagctcctggtcctggggagccctgtgcaacccactcactgcctttcagagccctgtggcgtctctctcatgcgctggccgtagagcttcctgaaagcatctctatcacccactctgcacctgagagagggcggtcaggtgactggtaccccctgaagacctgggaccaggccccctgcctctgggaatccatcaaaatgctcccttctgaggccgctttgctgggcgtaggatcagccttgctttgagggctgtttaggagaggaaccccggcgctgctgctccccggaggcagccagtgcttgtgatgggcaccctgcctccagtgttctgcttcagggtgtgggatgcacagctgggggcaggggcgctgctgaagccacagtctcagagcctgaggcccacggggcatggcatgaagacccggtggttctgttcccccgggacagccttggtccagcctcactggccacatgctctgccgagcacacccgctgctgtccccagccacccagccccatgcacaggccacgcggcgacaggggctgctgaaggaaggctggtccgctccctgcctgtgacaggagctcaggctcagggcagcaggggcgctcagctgggccgcggctccacggtgttaagggattctagaaatttcctgctgtgccaggctgcagcagagactccggccccaccaggcttcctgtacttggtgataaacacaccatccgcactgcctgcggctcttacaggaatctctcgtgcaccattgctcaacccccgagagttatggaaggaagggaggctggggtgggtgccccgagtgccttgttggagtggaggctggcgctgccctgccccacagggtggctggcagggctcagcagttgcctggcctgtgggggcagaggacctggggagacatgctgagccctcccagcgagacactgagggtcgggagggtaacatgtgattttgaggccacccgctacagcttcttgggacctccttctctcaggcgggtctggaacccaacagagctggtttgggccacagcagtggcttcccaggctgggcttcaaaaccggacacagggcgtggctctccctcccagcctgccagagggaccgctgggcctatctccagccacgtgggtcgcgagagtcgacctgggctgcgtgatgggggaccccaggctgggcggcttaaaccgtggaggtcgccctctcacagctctggacgatggagggccgagacccaggtgtgggcagggctggttcttctgaggcccctcccggcttctgagggtggctagcaactgtcttctagatgtagtaccccaatcccccccagtccctccctttacctcacagggcatcctccctgcgtgtgagtctggagccaaatttctcctctatgtaaggacaccagtcttactggattggaggctaccctactccactgtgacccccctcctaactgatcatatctgcagggaccccatttccaaacaaggtcttactctgagtactggggattagggcttcatcatatgaatttgagggcaacccaggggtctccaaaccatggcccacagggtggctccctgtgtgtgtaaataaagctttattagcacacagcaccacatacttgagggcctaatgcctctggctgctttgtgccatggcagatttgagtcctgccatggagaccatgcagcccacagggcctaagatttctactacctgaccttccaggaaaggtttgccacgctatttatttagcaggataattttggaaagagcagttgctaggggcatttaaacttgcagtcgaattagtaacaattttattttttgggaaaatagaagtgggagagcgtgtgccccgggccagcccaccgtgccccacgtttctacagtgcccaggttggcgcagggccttttggttccacagtctgtgtctttcttcctgggtgtctgaattttgatttaatctcaggcttgtcagaacgagcagctcccaggcaccctctgccaggtcagcagtggctttcatcttctgccatttgctctgcacgtttctctctatatgcaaaaacctatatgggttttgtggggttttttgttgttggttttttatttttatttttttgagagagagagggtcttgctgtgttgcccaggttggagagtagtggcatactcacggctcactgcagcctcggcctcctggcctcaagtgttcccacttcagcctcctgagcagctgggactgtgggtgcgtgccaccatgccccgctaatttttgtattttttgtagagatagggttttgccatgttacctaggctggtcttaaactcctgagttcaaacaatcctcccacctcggccaacccaaagtgctgagattataggcatgaaccactgcactcagcctgctttgtttttatcctgagtcatttgagagtaagttggaggcagtatgaccgtttctccgtataaagcccgtgtatatcctctggaatgaggaccttcaacttagccagggtgtccgactctcaggacaccgctgtccatttcacagcctgcatttaaggctcgtcactggtcccagtgagtgtggctggttttttctcattgcacatggctgtcacgcggtttcagcttctttgacctggagcagccctgcccggccttcccttcttggtctctctcttgggcagggaagggcggtggacatggaggcttggggacagtcccctggccccacggatgttgtgtggacgagttggagggctcacaggcccctccgtggggcccagggcagaggcagcaggcaggctgtctccaccacgatggacatcatttatgccccagccaggtcccctgtcccaggaccgcggttgacagggtttggattggctgcgttcctgtctgaaggcagctgcttgggaggaggacagctgacattctttcatgcgaaatctgcttgcgggagagtcgtgaaagtgggaatcctgggctggaaccggaacgttccccgagtacataggaatcctgggctggaaccggaaacttccctgagtatacggggccttgtgtgtggaggggccctacggtgaatcgttttctgtaacaaaggcttcctctgtgcagcccacacacgggcctcacgttatcttctgcaggccagaattgtcatatatatcaagtttgttcagaacaagatggggtggggtggggggcagtgaggggcctggggcaggaggtagaggaaactgcaagattttttaaaccttctccaaaaacacgtaacccgattctgtccaagcgatttgtgagaatggggttgacacccctgggctggaacctgggaaccaccagtcagcgtctttcctccagggaggctgtgcagagggaaggcagtgagccccacctgggtttgaggaacctggggcttcaagggaggcggtctcagcccatggtgctccggccaggggtggggcagccgaggcatgagtggacgatgtcccgtcggcagcccgtggtccctctggggggcaaggtgcctgttccccattgctcctccaccagaacacctcctccagatctccgccaggtgcgccccctgaaggaaaaggggatgggggcctggctcgtgcctggtggcaagtcctcttgggccccagaaagaccccataatggccaggtagaagctcctacctgctgctgcctgaagagtctggggccctgtcggctggttccatcgtcttccctgttttcaagctacaggagcgcaatctttccagagcattgagtggctagaggaacgggcttacgctaggcaggcgctggcatcttagacaatacctgacatctttgcgggagctctggtgagaggccccacaagcgtgtgaccctgtgcggactccaccgcggcagcctgggagccaagccgatggctgtgctggccgaagggaacaccgccatggtgctctgctctctgcagccctgggtctggttggaagttgcatccctggtgaagggcggccgcggctttccagctctcccaggccagttcccgtgttttctctcccgccttccccatagtccaggacaaaagtcagaccttggtggggggtgcgcctgctgcaggggcccccaggcttctccattcgggtttagtgggattagagtgtgcggccatggggacaggtgtttcctttatgttctgcctgagggctggaaagagcctcatcagtgagtgccacgttcggtgggggtctctggtgcaggggagccggcgggccgggttgggttatgtccttgttttcacatctgaccctggccagctggagagcctcgcttgaagcgcagggcagcagctgacacaacacaacgggaacgggctgagcaggccgggcgcaggcaggcttgggggagctggcactggcactgcacgtggggctcctagggggctgctagggaagtcattgggggataataggatccaccctgtggggcccactggccatggagtactgcacagtggggtccacccgctgtgtccctgaacaaggaggtagcctgaggtctcctctgacgctgggcagcagcctggggaggaggctgggcaggtgccaggggaaccccctagagggcattacattcagatgagttctaattatgttcttggcttcccaggtcacacagagtgaaaaccagaggccctggccgtgcaccattgaagtgtgtcatcatgtgactttgcaggttggggggacagggctcggtgcggcctcacggggtcaggagccacggctcgagcacctcggatcccagccccctgttcagggccaggcctagacagctcttcccacgagattttctttctcccgggtataaaactggccaacgggatgcctggtgggatgactggggtacctggggccaggggcggccagcagcctcctcagtagcttgtgggagatgctctcaaccccaaggtcagctccagctggcctcaggaggagtggatgttcccttcaggtgtctttaggaccctggcaactggggacaatagtctcctccccaaatatgcagtcttgactcctggccacttgggaaggtgcgttctggtcctctgggcctcacagctttgtgccctctagggtggcaatgggaggcagagagcacagcctggggacttgctgtgaggggactgcatttagatttttaggtgaagccaatccctgttgggctgagaaaagtcctgggcggctgtgagctggtggtgagttttccagacttggtcatggtcaaggtagttgaagtcgggggttgaaaaacacactcgtgtccagcccagatgccttatggagaagaggatgcacaggcacacacgcacagacatatgtgcacggatgggcgtgtggacgtatgcacacataggtacccatgtggacacactcacgtgtgtgtgcacgttcaggctcagacacgtgcctgcatgcacacgtgcacacgtgcacacccagccctggacctcaggcaggcagggagagagacccccttggggccgcgttccatttgcacatttaatccagaaactgtcagcatgggaagcctggatgagaacaaaatgtcaagtgtgtgccgagaggcgcaggccagccccttttcctggcggggcgatgatctggtcagtttccgagcaccatgtgctgagaatgatgcgtgcattcagagcagcatttggtggggaacctgggggaagggcgggcgtctttatttcattttagctttctttagcggggcctgtgtctcttctcactgaccgttttctgaaactggctggggagggtcagggatggctgctgtcctcgggggagggactgagctgggcccttttcgttggttagttctcagtgtggcctacccagccaggtccctggacctggcggtggctatgaaagcctgggattgaggacaaagccatggggacgccgttttcgggatgcttgtgagcagggctttgtccccaccgttaggatactctgaacgttcccagaaagcccccttctgctcaagttctcttgcttcatctcaggctcaggtgttttgagttttttttttttttttaaatgaggacatctgttagaccacttaggagttctagaacctttggaaaaccccctctcatcccgggagtttgtaagaatttgtagtttctccccagagttcatggagcccctgtcagaggcgctgaggcccaggtcctgtggctggtcctcgcatagacatcagctaagggggtttgggggccagtcggcagcctctggaggcctctgcacccctcctgtgaaaggccggcgcagagctgcaccgtggggtcccctggcttggggtgggcctcagaggctgtcgccgtgcctgctgtggctctccatggccctggagcctgggattgcagaaagactcccagaccttgctggggaaactccaggatatgggggtatccagactcctgagacttccccgtgggtccacacacgtcaccaatcctctctgcacctcagcttcctcatgtgtgaaattcaggtcatatcaggacctcagttcctggggctgtgccgagggtgtggggacattgggcatgaaggttctcagtccagagccaatggccaagagggcaaaagggtgttggtggacgatgcctcctcccctggcgggggcggggaaggaagtgctgggggaagccggtgtaaggggccccgtgcccaccaaaggcgcgctaattgcgaaggaggggcctcagccaggaaccgccatagcctcagttttatttattctgctcactcaaacaaaaaatcagctttgttgaggtataattggcatagagtggaaggccttgtttaaaatgtaggatttgacaaatctggacatgggtgtacgccacaggaccatcaccacaattgagacagcaggcacatccgtcacccccagaaggttctcgctcccgtcgctggcccctcctccgctgctcctggctccggaggggacccctggtctgtcttgtcagtgtagacggttggcgttttctggggcttgttgtcagtgcaatcatacagtgtgtggtttttattgtctggttccatatttgagagtcatccaggctgtggcatgtaataattcattcctttttcattgctgagccgtatcccattgtacggacgcattgcagtctgtttatccacttgtgtgctggcggactctgtataaaagtgtttgtagggacttatatttcctttctgcatgggtaaatacctaggtatagaatggctggataatgtggtgagtgtatatttttaactatttaagaaactggctaactcatcaacccttgacgtggtccgtcattttcatgttagccagtctaagaggtgtgcgtggcatcctgctgtggttttaactttcatttcctaaggaccagtgatgttgaatatcttttcacgtgtttcattggcatccaggaaacatctttggtgacatatctttttaaatgtttcacccattgtaaaattgggctgtttgtcatctgagttgtaaaagttctttgtatattctggttacatagatatttgttttacacatgtattctctagtcggtggctttccttttcatttatttagtagtatcttttttttttgtttgagactgggtcatgcactgtgctcaggctggagtgcagtggcgtaaacgtagctcactgcaacctcgaattcctgggctccgaggatcctcccacctcagcctcccaagtagctgggactataggcatgtgccaccacaggtgctaactttttaaagttcttgtacagacagggtctcactttgttgcccaggctggtgtcaaactcctggcctcaagcaatccccttgcctcggcctcccaaagcgctggaattacaggtgtgagccactgctccaggcccaatagtatcttttaaagaccaaacattttcaattttatgaagtcaaatatagctttttccttttaaatatgtttcatgcttttcacattctatttaggaaatgcttaccaaacacactcttactaagattttctgctagtagttttataatttttgtgcttacctttaggcctaggatgcattttgagttaatttttctctatcatgtaagacataggcggagattcatgtgttttttcttatggatgactgactggtccagtgtcatttgttgaaaagagtatcctttacccagtgaatcatcttgactccttttaagaggttcagtttatcataaaattgtctctttctggacactctactgtgatccgttgatctgtccttttgccagtcacacactgggattgttacagccctataatacggttaaaataagttagggtaatttagccaactttgttttgctatttcaagttgtgttggttgttcggggtcctttgcatttacatataaattttggaagctgcttaccaatttttgcaaagcctggtagaattttgtttgggattgcattcaacctaaagatcaacatggggagaattgatgtcttaaccaatattgaatcctctgatcaatgagattatctatctcatatatatatatgtgtgtgtgtgtatatatatgtgtatatatgtatatatatgtgtatatatacgtatatatgtgtatatatctatgtatatatatgtgtatgtatatgtatatatatgtgtatatatatgtgtatatatatgtgtgtatatatatgtgtgtatatatatatatggttacatacctaatatgtatatggttatatatctcttataagggttatatatctcatatacatatgaggttatataccacttatttagatttttaacttctgtcagagatgtttcatagtttttagtgtataggttgtacatcttttgagatacctaagtgtttcatattttttatgctatggtcaatggtatttcttctaatctagaactgaaattcattttgacaaatttatcttgaatcttgcaacctttctaaactcatttgttccagtggcttttgaaaaaatgaattccattgatttccttatatgaatgatgttttctgaacatagagacagttttacctctttttttcaaatgtggacgcctatttgtttctttttctggcctgattgcactgggcggctcatccactgcagtgtccaatacaagtgaacactgctgtgtccccagccttagaagacacacatcattgttcaccgtcaagggtgatgttggctctgggtttccatagatgtctttaccaggttaaggaaacgtcccctctaatactattgctgagagcttttaatatgaatgggtgttaaattttgtcaaatgctctttgatacatcttttgatatgatcatgtgctttctctacttcagtctcttaatatgataattacactgattcattttcacaggttctgtattcctggataaaccacacttggtcatgctctagtattctttttgtatatcattggacttgacttgttaaaattttgctaacaacctttgcatctaggttcatgagggatattgtctatatattttcttgtaacgtctttggctttggtattagagtaatgctggcatgaggagtgagttgggaagtgttctctctcccttttagaggtggagtttgtgtagaattggtcttatttcttccctctgtgtttggtggactccatcaggaaagttgtttaggtaggcctggactttgcttgatgagaagattgttaactagattttaaattgacttaatagttttattcaggtgattgataatagttatattcagttgattgataataattatattcaggtaattgataatagttatattcaggtgattgataattatattcaggtgattgataatagttatagtcaggtgattgataattacattgaggtgattgataggtgataattatattcaggtgattggtaattatattcaggtgattgataattctatttaggtgattgataattctattcaggtgattgataatagtggtattcaggtgattgcttcttgagtgggctttggtattttgtgtatttgaaagaatatgttcatttcatctgggtgttaattgtattggcataaagtttttcagaatatcctgttactatcctttaaacagctatagaatttgtagcaatgtctcttctctcattcctgatactagtaatttgtgcctctttctttgttagtgtaatcagtcagctaaagttttagcaaatttatggatctcaaagaatcagcttttggtttcattattttttttctttttggttatttgattaattttaattattttattctgcctacttagttttaatttgttcttttttttctcgtttcttaaggtggaagctgaggtcattgaatagaaatttttttttcctttctaatacaggcacttggtggtataaacatccacaaattttgtgtttttttatcccatttaaaatattttctaatttcctttttaacttcttctctggtgtatgcattatttaaaagtgtattcaaaacatttagggattttcaagatacctttctgttactgatgtctaatttatttatggctatagaaacacttaatataatttggtctcttaaaatatattaagacttgatttagggcccagaatatgatttatcttggtaaatactccattgtgtgcttggaaagagtgtgtactgctgttgttgggaggactgttctataaatgtcaatgagactaatgtggttgatgatggcattgtccaagtctacatcagtaatgatacatccttactgattttgtatctacttgttctattaattcattcttgggagaaggatgttagaatctccaactgtatttgtggatttctctcgttattcttcagttctttattctttattagttttttgtttaatgtattttattttttgcttttgtcatttaaaaaattatttacattctttatttttcatttttgtggatacacaatagttgtacatatttatggagtacatatgatatttcaatacaagtataccatgtgttcaatgtgttttgaagcttcgttcttgggtgcattagcatttaggattgttatgtcctcttgagaagtcaacacatttgtcattatgaaactgcctctttatccctggccactttctttgctctgaaatctgctttgtctgagattaatatggctattctggctttttctttttatcattgttagcatggtatatattttactcatttactttcaaaccatttgtgtctttagactcaaaacttgtttttcatatgaagcatatagttgagtcttattttgtgagtcaaactatttttctcctgaaaagtacagctaatttgcatttattcataggactgacattcttggtctcaactctgtcattgtcttttataattacgtgtattttgtcacggttgctgttgtagttttctttacaatatgtgtattattttcttttaaaaacatttgggtaattaggaggttgtattatttatttatttatttttgcgaaacagtttccctctgttgcccaggctagagtgcagtggcatgatctcagctcactgaaacccccatctcccagggtttaagtgattttcgtgcctcagcctcccaagtagctgggattataggtgggcgccaccacacctggctaattttttttgtattattagtagagacggcgtttcaccattttggccaggctggtcttgaactcctgacctcaagtcatctgcccgcctcagcctcccaaagtgctgggatcacaggcatgagccaccgtgcccagcctgtatttttgtcctaatagttacctttatacatatgcctttcaaagtttccttggtccctggtttctcatttaaccctttacagtctggcttaccgtttttattaatctgccttaacttctacttagtgcctataccacaaacaataagctgactccatttccatcttttataagttcagacccccacaaccttgggtggactactgactacttcgcgggtaagaaatggtgagtggcatggaaggggaggggcggcagttctcagtggagcggccgggctgcgagtctctgtatggaggtgaaggtccagatgttggggtttcagggtcaagcattcctggcagagagcatggcacgtgccaagacccggatggggcgtgtgcctggcgcgggtggagggagctgtgaggagcctgtagcattcagagacaggggagcagggagcggtgggggatgaggtcagggaggtggcaggacctggcgtgtgagggcttggggcgactctggggagttagggtttcgctctgcatgacaggagcctggggcctggcatggtgtgactcagacttaacgccgcccctctgactggtagaggccaggcccaggataaggtggcggcaggcaggtctctaagcagtggcagctcagacccgaggtcccagggtcatgcgtgtttgtcctgattgcacgagtcgtgtgagcacagaaacgtaggtggaaagatggtggcttcgtccagggaggtagactgggaacgtcttttgctgcttcccttggattttgtttctcaaagtctgaatcaagcgtggcagaagaaaatacagcagaacatgggatgggaatatccatgcgtataatcggtcaggttagttgctgtattctgacttatttgaaagatttcatagcgaacaaagaaaaattccggtataactataatttttccatagcagtttatattccctttctcagccttgtaggtgtaggtggagtgtcctaagctctgggggtggggggacacgtttacgtgtctgcaaaccgctacattctgctaagacatctcaggagcccgccaagcccttagtgaaaagtttcttaaggcggtttcataggtgcgtgtggggctgttggatacagtgacccacttcaaggtgacatcttcttcttgcatctcagatagcaccaggtttgtgtgtttatgcgtgtgcacacacggtgttgggctctggcggtggcctgggggtgcttaggctgtgcacaaatgcccacgcacgtacacacacagacacacagcctgacttggcccaggtgggtgggtgtctgaggagaagttcgccattgtcgactttggggtaaagtgaggacctgtctggcgggaataaaggggccctactgtcccccgaataccactgccccagccctcctgagcccctgtgactgaaaaatcctcactttggaggatgtttggtgacaggtgctggggcccggacacgacctggtttcttcatcccaggggctgtctccagggtgggttctagagtacatccagcttccacccaagggagagtggctgggtggagagggggcaggctgagatctgagaagccaggctagggggttgtggagcaaatgatgatgtctcaaccatgtggctttaggtccccagcacgtgctagtggccatcagcaggctacagcatccagccagtgccaccaggagcccactggtgccaggatgctggggtggggctatggggaaggaagacatgtgggccagggtgcggggtgcgggacaaacctgggtccaggcacctggggcgaccctccttggccgtccttgccatcctcgccatcctctctccacacatctgacctttgcctgctttgggggcagtttgaggcctcagattttctacctcaaagcgatggaacccagaagacatggggccctcgaggagggtcccccgggggctgcaaaagcagagggagtggagtgtcaccgggtgtcccggcgtgggcaggtcctgttgtggagcctcgtgacctgctcatagcacagctgggacacttccagtgactgctcttcgaggcccggggtaggggggtgggggggcctcctcctcccaagcacctggggtgggaacaagaggcgttttgtgttctgcgtgggtggccctgggctccccaggcctggtgtgggggtgcctggggggcagtggacgtgagcagcagcacgtggcccccagtcatgagtaccccaggcccctatgcgcctccttccccatgactggccctgggtggcggagagacccctgggcaggacacccctccctggcttttccttctgcaccactcaatctgggggttccggctccttgcccaccgcccccgccacccagcgcgagccgcgtagaggagcaggaagggagccagctccacctccagtagacccagagacggggaggccagggtgcaggggactgtttgggcctcgagagggacggaccccagaactggaccccaatgtgcaggtctgggtgtggatgtatctgtatgtctttgcggagctcagatgagagatgctcagagttgtctgtagagaaccagagccgccgagcccggcctggatggacatcccgcaggcagtgcacgtccctcccccgcctctctttgccgttgccgggactgggccgtgtgcctggagtttgaactttcctgatcacggggtgagagggtctttgcagttgcagagccgtggcgtggcgcctggatttccgacacactgcagcatctgcatccttgccgtcacccctcacaccccctgctaaggtccctctgggggttgaatgaaaaggcataggtagaaggtgggagaagcccacgttctgggagcgtcgcagtggcccagacacccatgttcctccctaggcagctccatgcgcgggccccggagctggaaagcagccaagggcactgcccgccctgggagctgatgcctgacatgcatcctcgcctaggccagagtgccaggcagggtaggggaacaaatgccaacacgtgagctgagtgaccggaagagggggcgcctccctgagcaggtgaatgaagggtgctggggtggcgagttgagggccaacagagatggtgtcccggctgatgtagggtcaggggcttctggaaggagcctcacaggaagggcagggcagcaccaggctcagcccaggaccagagcgcaaatagggctggagtcccgagtacaaggcatggacaggagccaggcttcacctagcacctggctccccgggggcccagatggcaggcgaggggtgcctggggaggctgccaagtgaggggggggcacagactgagacagggtccccgtgttccatccatggggtacagctgctcccaggccagactctggcggtagcaggaggcaggggaggctgtgctgagctcagtgggtttggtggggtcatagctgcctctccctctaaatagattaactaaaaagtattgttgactgactcatgcatttcttaggttttcttattttctaatttcttcttttaaatttaggtttgtcgaggtttaagttacatacaggaaaactctccccctctgtagatgtccagttcgatgagtcctggcaaacatttatggtcctgtaaccacccccaaagtcaagatccaaggtgttcccatcacccgaaagctccctggtacccactggcggctagcccctccccgcacctgggaaccgtggacgtgtttcctgtccccatggttttgccttttccagaacgtcatgtgaatggaatctcgcggcgtgtagcctctgcgcctggcttctgtcacttagcataattcatttgaggcccatccgtgtcatggtctctgcattcagcagtttgtctccttttatttggaaaggataaaatgtaccacagtttgtttatccattcacaggctgatggacatttgagctgtctccagttttcagctgttatgattaaagctgccatgaatattgcgtgcagttttttgagtaatcatatgtcttcatttctctggggtaaatccctgggagtgggattgcgggatcatgtgttagatgcatattttcctttcgaagaaactgccaaagcattttgcaaaatggtaggcccgttttccactcttaccatcaatgtacgagcattctggctcctatggattctcaccagcacttagtattgtctgctttttaagctttgcccatcctaaaggctggagccatattccgtcatggtcttcatttgcatttccctagtgacgaatggtgttgggcatatttgccattcatatatctcctttgatagaggatctgtccagtttgttgctggttttaacaattaggttgtcttcttagaataatcatgtgagttgtaagagttgtgtctatgttctggatatgagtccttcaccagatctgttttacaaatattttctcccagtcatggctttgtctttgcattttcttaacaggatctttcaaaagagcagcagtttttaattttgatgaagttcaattcatcagggttcttctttttttttttctttagggttcatgttctttgtgttctgtctaagaaatattcgcctaatccaagattacaaagttttttctcctgttttctgtagaaattttatagtttcacatttcttgtttagatctgtgattcatttcgagtttaattttatatatggtgacaggtatggatggaggttaaatctttctgcatgtggttatccagttgtcccagagacttttttcccattgaattactttggcacctttgatgaaaatcagttggccgtgtgtgtgggttcgatttctggactttgtcatctgttctgccaggaaagcactgtcttgattactgtgacttttatgctaagccttgaaatcaggtcctgttaatcctccaattttgttcattttcaagagtgagctgttctgccagctccttcacattctcatgaatatcttagaatcagctcgtcaattctaccaaaaaaaaaattggctagaattttgattggcattgcattggatatgtagataaatttggatctcatacacgtcttagtaataccgagttttctgatccacgaacacggtctctctccccagtgcctcatgcacgtcttagtaataccgagttttccgatccacgaacacggtctcgctccccagtgcctcatgcacgtcttagtaataccgagttttccgatccacgaacactgtctcgctccccagtgcctcatgcacgtcttagtaataccgagttttctgatccacgaacacggtcttgctccccggtgtcttagatatttttcaacaccactcatcaggattgtgtaatttttagtggtgtgaaacttgctagatttgttcctaagtattttatgtttttgaagctactgaaatgatattgttttctcagtttcacttttggattatttgttgctaggatatagaaatacaattgatttgttcgtatattaaccttgcgtcctgtgactttgctcatgttacttattagtttgagaaggtttcttgttcatctgttttgggggttttttttgttttttttttttttgtttttttgtagattctttaggattttctatggagatgattgtgttgtccacaattaagtcagtcttatttttgccttttcagtccatatactatttatttcttgtttttacttgaatgcacctgacagtgtctgccagtggggagagggctgctatccttatcttactcctaaggtgaagtgaggtaatctttcaccattaggtgtggtgggagctgtagggttttagtagaagccacttatcaggccaagaagttcctcctcttcctggtttgctgggaatagagagtgcgtcaagaatagctgttggattttttgacaagtgctccttctgcctctattgagataatcatatcatttgcaacaatctcaatcaaattctttcttaatttgctagtgtggggaatcgcactgattgactttcaaatagcaaagcaaacttgcttcccttacacaaagcccacttggtcatgatgaatttttattttattttattttatttatttatttatttattttatatgtatttgtacttttttaaattttttatttttttgagatggagtcttggtctttttgcccaagctggagcgcaatggcgtgatctcggctcactgcagcctctgcctcccaggctcaagtgattctcctgcctcagcctcccgagtagctgggattacaggcgcccgccaccacacccagctaatttttgtatttttaggtagagatagggtttcaccatgttggccagggtggtcttgaactcctgacctcaggtgatctgcccgccttgaccttccaaagtgctgggattacaagcgtgagccaccatgcccagctgtcatgatgcgttttaaaacacctttttggatgtgactgacttcggttgtgtgtagaacttccacgcccacgctcacgagggcgtcacctgccatgtgttggctgttgtgtctggttttggcatcagatgccgctggcatcagagaatgagttgggaaatatttcctgctcttcaatttttaggaagagtttgtgtagaattgcaattatttctcccttaaacatttgatagctagaacatgtggaggtatctgggcctggagttttctttgtggagaagtttgccattggaaagtcagcagatacagggctatgcaggttgtctatttcttcttgatgaggttttgattgttcatgtctttgaaagtatttgtccccaaggagcagaagccccagcccaaatttggaaacaagaccatgttgtgctgacatgtcattcctgagcagcttaggggctgtggggtttgcagacctctgaatgcagccatctgcagggggaccctcctcagtgccctgagagggggcctgggctgggtggtctctgctgctggccatcccactgggcactgcctccccagggattctgcaacaggacaccgtaaggggcacgggggacaaagatcagactttctctgtttccttccagctttgctccccagggaggcagtcccttctcagaggaatgaaatttaagaagacaggccctacaatttcacgacaagtctgcttttgactctcccgtttactgtgtaaacttcagccctaaaacaacatacatccttctgaagttgttcacatattagctcttaaaacagcaaaatccgtgcacaatttcctctcaatcccttaaaacattcctgaaagggggggaaaacaactgtttaaattcaccgcctgttattaaaatctctagatttgcagaatcagagtgaggtactcagcagtcagaaaacagactagacaggcccgtgtgcacacacgcgctgacacacgtgcacacacacacgtccacagggcagcctttaataaccgcaggccttcctgtcccaacactgcgcgggcccctgaagggccggtgtgggttgcagctcctcaatctctgctaaagtaaacagggttcaaccctgcggccttctcagcactctccccaagtcaaaagaagggtgctcagcccctggtctctttggtttgccaaacttctagtgctggtgaaattcttaaatatgacatttttagaagcttcggctcctggcagataaaaataatgtcccccgctccacccccttttccccctatcccagttctagctaagacagtgatcagaggggtgcaccgtctttggggttaacagccatcagcagtggggttcccaggctgaaactaaatcctcgtttaactggcctggagacggaaacagccctgcctggggaagatgggggatttgctttaaatacgtgtaaagctgcctgccaggcggctaatggtgtctgcagccaggcgtgggcgtctccgggccatgggctcccccaccacaaattgcagggcagccggcttgggccactcctgtgtgtgcggggccctgggtatgattcctgggaggcagctcccaaactgtggggctcagcagaggattcagggcctgatttgcaggcagccccacctgcctttttgactgttcagagccctgagtgcctcccatatgcccacattttcctgcccctgggccttttcttctggtcatcggcctggagtgcctccactggcacattgagttctgccttcagagcctgggttttctggtggaatggggcaggggtaggctgatagacctcttggagagacagggcccactttcttgtaggcccacagggaccccgcctggggagagagaagcttcaggccctgaggcctatggcctggacctctctagagaccctagaacagacctctggcctggccttgctgatgacctggagcccctgggtgccagctgcagccccctgcctgtccaggagtctgagctccaggtatcagcgaggtgggttcgttctgaggctgtgagggagtgttccaggcctcccccagctactgtggaagggttcccggtcgacgcatcgcaccagaccctgcctccgcctccatacagtgccccccggcctgcaagtccatgtccaggtttcccgtttgataagaacaccagttgtatgggaataggggcccaccctaaccacctcatcttacctaatagcatctgcagcaaccctatttccaaacaaggtcacactctgaggtgtgctggagggtctaggacctcaacatatgaatttgcggggcgggggacacagtttagccggtaggaatacctacctgtcagaggattctttaatccaagggtccgtaaaccatagcctacaaacctggctgctgatctgtataaataagatttgattagcacacggccacgtgtgcttgtgaacatctcatctctggctgtttttgtgctataacagcacaaaattgtctgctggagttgttgcaacagaaatcgcgtggcctgcaaagcctaaaatatttactatctggctttagagaaaaagcttgtcaagccctgttctaaactatgaagacaatgttggaggttgctttctatacccacagagccgttgatggggtgaagggagaggggtgaaatgcagtcacacgcaaattcttatcttcctgaggagaaagccttagggagcccactacagtggacactgtctttagagagtagcagacctggctgtgagtttgaggaaccagtgaaatgagagttcagtgacatcctcaacttcatgaggatcagaacatggataacatgtggctcaactaaacaaccaaaagcaaaagggagaagtcaacagagtcaaatagcaaatataaggacagaaagagtcaaatcaaatgcctccaacttcacaccaaatgtaaatcgcctgaattcctctttgaaagacagagaaggccgtgccgtagctctgggcttttatcttttaacaaatacattgctcagcagcattaagtaaggcaaagcaataatgggtggttgaaaaataaaggaatggccaaagagaggccaagaaactgcaagctaaaagaagaaaaggagagaaaaaacagggagatcaggatgaatatcaacactgaagcccaaacaagacaagtgtgaatgagatcaggcactattagaagacctgactgtaatctttaaggcatcatacaacataaaatacataaagcaaaaactattgaaaatctgcaaggacaggaaggttaaatatgataacgggaggagattttaatgtacctcttttggaataggacagttctagtgggcacaaaataagtgaggacatggacaggtaaatgttgtaatcatgagcaatttcagattctaacagtaatttgaaataactcctgttcttgttatctatagccatgtaacaaaccatccacaaatctagcaccttcaaaatacgcatcacgcctgagctcgctagcctacagtctggcagggctcagtgggacggctcatctcccctctgcatagtatcagctggggctggagcctccacagcattgcatctacatggctggtaaggctcctgttcatgagggcttctccaaggctgcatggattcctcacatctcagaaatgaacagtccaggagacaggcagtgccagggactgagagccacctggctgtattctcctgatgcaggtgtcacagagcccaggttcagttggggaggactggcaaagaacttcataggactgtgctttaaaaccagcactatcacttcgaaccctagtaatggagttgttttgttcccttatgtctgcggaacacttacaaaaccaatcattcatgtggctacaaacaaatctaacctacctcaaaaaattgagatttaactggccatgttctctgatcaaaacccaatatcatgagaaataaatgattaaaagattggggaagaaaaatcccttacctatttgggaattaaacaacactctcctaaatagccagaaagaagagattgatgtgggaagtgcgggccctgtagggcgttatgagacgtaggccccgctgcctgccccagcccgtacatcactccagctgccccccagcaccaactgtagatgcttttattttgtaaattccatgccagtgcccacatcgcttgctggtggcttcactgtgtttgcaaatgttgtcccccacgtggattgaaattcatctattgcctgaaagtaatgaagtatgtgccttgcacactgtgtaagcatacgtgtttattcagtgcgtcctgggttctcaccccttgccaggtgatgggttgattcagtgtgctgggggtctccaggcgggggggtccacatagtttttgcttcatcagaatctgctgataagcccagttcggagcagagactagatgggccagcctgtgggcactctgcctagcgccatctgcctctcccaccccaggcaggtgtcaggtggctgctgcgccctgtgtccgcctcctgaccttgagaacacccaggtgggggaggaagtgggccgcgcttcgggaacccccaccccgccggcttgcgcagcgagctgggtcccagggctggaggcacctcattaaaccgcctgaaacgtgtgtaactctagtcggcccccgtaaggcaccggcagtacatgtgaaattaaaattactgagaggccccactctcctcccctccatgggtgggcagccttcatggggaggccaaggcccggaagccggcagtcctgggaaagatttggccccaatgataatgggcccaagaatgtgctaggcccagggtgtggtccaagttcctttcttagctaacccctccaccctgagaagcctcccccactacacccacacatggggccagctgccttgagcacctcctgctcagacccaggtgaggtacctgagtgacaaatgtcaagagtttgcagttactcccagagctacggacaaggggcaaggtggggctggaggcaccggctcagcaagaggggtcacttgagccttggcctgcagggaggttttgctcaaggagtgtcccttgagcaaaatattgcactttcgttgctctctgaaagcctaccaggcagtcttcccagaggtgcttcccgggaagcccgtggagaggatgcattcgacacccaaggccttatggaatcagtcctggggcctggagggtcgtagagaaatgtgtgaacatggctccccttaggccaggggtagacgcaggcacagggaggatcaggaaagccctggatcttgttgacaccccgggatgtgcccttgtggctacttagacgtagagcccggggcagggggagggccagcccctgtggttttagcctcctgagagtctccccagacagcccacaggggacactgggcctcatgccgcctgtcaggatggtgtccgggatgtggggaccagacgacagctgtcacccacttgcagggcccggctgcccggtggatgggaacggccatccccatgacgacccagcaagtcccttgcctctctcgctcaccaggaagaagacacgtccgggcagctggcaggtggggctagttctggagggaaagcggcctcgtgcctcccagagtcaccccgaaatcattaacggggagacaagcacacagagcagctggccgattgcagctctgaaggtcagagatggccgccagctgtgggaaggcctgtggctagggctctgctgcctgcttcctgggcaggggctccttcctccctctctgtctctggggtcccatgggaagtcagggtggggcctggtgtgtggcttccgctggtttcctgggtgtgtcttcctgcagggccaggacccccagagtgttccagtgacttcagagaggggcagccagaccaggaggagctccagaggtgccctgtggggagaggcagcgtcccaaacacgggggagggggtaccgccagcctggggacagatagcagcatctcagccatggggggccgtgacatccggtcaggagggggttagcatctcagacatgggggggagatgtccagcccaggggaatgaggggggtgatgtccatcctggggaggggtgacatccatcctggggggacggaggcgtgacgtccatccttgggggatgggggggtgacgtccatcctgggggagtgggggcggtgacgtccatcctgggggagtgggggcggtgacgtccatcctgagggaacaggggggtgacgtccatcctgggggaatggggggggtgacatccatcttgggggtactggggggtggcgtccatcctgggactggggggtgacgtccatcctggggggacggtgggggatgtccatcctggggggacggggggtgacgtccatcctgggggcgggtgatgttcatccttgggggacgggggaaggtgatgttccttctgggggggcgggggggggtgacgtccatcctgggggagacagtaacatcccaaacatgggggatgatgtccagagtgggggtcttcaggtctttacgggcccctcagcctccccttccacaccccaagtacagcacccacaaggcaggtgcctgggagggagacacacctgtcccctgcctgaagtttctcagcaggattttgggcacaaggtgggtagtgagctggtctcagcactgagcttgcaggtggagaaggcgggcccctgactttagggcgctctgggtgggatgaggacagacgtggaggaaaggagggatcccagcagaggcagcagtggatgggggagggcttcaccgcagggagagtgaggctgcgcggtgccctgcaggacagataggaactcccaggcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcagtagaatggtgtgaaccccagggggtggagcctgcagtgagccgagattgcgccactgcactccagcctgggcgacagcgagactccgtctcaaaaaaaaaaaaaaagaaaaaaagaaaaaaaaggaactcccagggtggagctgtggacagataggaacttccacagccaggaaggccaggtgacgtggagggccccaggcagctgggccagcacgggacggggcgtcaggtcagcggggctcttctgtgctgtgtgcagcatgagagtctgtaccccacctgtactcaggaccctgccccccgaggacaaggtcgcttccctcttgagcacatgggacaccaccttcctgctacactattcccatgccctttccacaggcccaggccactgttgtcatttcgccctccccacagtcctaggaggtgggcactgctggtgccccattttacaggtgtggatgctgagcacagagaggctgagctgctcgtctgggtcccccgcctgggatgccaccagtgtcctcacaccagcctgctcctgccctgtgcccatcctcctcctgcttagcgatcctttctcttgctaatgtgtgggacaaggggctctcagggggcctggccaaggtagcgggtccccccaccatactcccagtgccacccctggctgcctggagctagctgtgcaggggcccagaagccctcccctccgaggaggtgggcctgttccaggctaccttgggcgggcagggccttgggtggccagggcctcaggagggacacagagggccccactcaaggtcacgggctgcacgttccatggggcctggggaagcagccgagcagaaggatgcagcccgactaaggctgcctcagggtggcaccccagcggtgcccacactaaggggacacttggcaggggaggggctgtggcagggcagggtcatgtccccagcagtaaggccaggacagggcagccggaccccgactgtgccaccctcagcccagtggatggtgcatctcacctgggcctggccggctgcactgtggcgcctgccccaggccaggctaccttgggcggggtggggactggtactccccggggggtgggggtgagggcggaggtgagtgtggatgaggccaccagctgtgcccagcacgtcactgagggcccacaagctctcagcacaggctggcggctgagagcagctggccacaggcaggccctgggagcaaagggcgctttgagctgcctgagtgcctgcattgccctccggccagctgaccctccccggagccgaggctggctctctctgtggcttatcagggccgggccggtgtggagttggaacagctggccccaaagcccgccagccgggctctatgctgtggggaccactgcccccacagggaagcgcctggctcagcacaggcccagccctctggcttcctcgctatgggagggggtgagaccctaatcccgggtccccacagcaccctcagcctaacccctgtgtccacccctcttcagagtctccaggccccatcttggcctgatgaggcctcattgtctcctaaaaagtgtgggtacagatctcaggcttttcaagggtgggtggattcctggctccagtggaaggtccccaggcctaagtctatgggggcgccagggaggccggctgtgtttctgcatccttgaccctggccccttccacaaagctcagctctgatccttcgtatttaatcttcatcttccgccgtctttaaaattaattttcctttaaagatactgtagagcagtaacatcagagacaccaaaatagacaaaagagataatagaagagtaatatcagagacactaaagtcctcgcgataagggtctgcgaggcttcctttatgttttgcaaaaaaatctatatatttcatccagagagacaggatgtgagcgcagctggtcagaaccagttatttcaggctgccctgtgatctttcccacgtgattgattgacacagggaccttctctagggtcctaaattatgtggttccagcagcatggaacttcaaaacacattgaaccccagaaaatcttcgctatgttggagattcgccggctgataaaagcaaaacaatagataagatggccaggtcgaccttcagccttctcggagaacaccggttccacggccggttgcaacacgtttgagccaaagtgcgacctttccccgctctgttcactcggagactaaaaatcccagataagcacctgctttgctagacccttgctggccctccggcttcgggcaggtctcctctttatgccactgtaaccccacaacaccggataccagcatggggccggcctgcggggccatgtgtctcctcctgtgtgaccttgagctaccttgagcttccattttccttccgcaccatgcactgatttcccctgggttgaggttgagggtcccagggtctgtctgcctaatgacaagatttcagtaccaatagcgaagccgtcagtggcagtgactgtgccttagggtgtcccgttggcatccagggccccccatgaaggatggcaccgagcaccattcaacataagtcttgtcagcgttccgatgaaacaagattaggggaattttacagcttgcctgtgtttttccacccagggccctttgcactgcctgctatttgttttctgtcttcatcctgagagggctcaaggtctgcatgccattttgcaattgacaaatggcttgtgcttagctatttcgttgaatgctgaactaacaatagtcagtgaagattaagaactaaaggctcaaggacagctacagatgaccacagctggagtgcggcagatactcggggccgctgggtggccctgaaggcccacagaatccttttggagacctgacccgcgggagcccaggtgagcaaccgccacgggccagggcccctcgaggcactcatttcagtatcagagaacacacataacgtaaaattcaccatttcagccatttcagccatttcagccatttcacagcgtgcaatttggtggcatttagtatgttcacaaggcggttcagccaacacctgtctccggttccagagctttttcatcacctcaaaaggaaaaccatccccattgcccttctcctagttcctgacaaacatgttctttttaaacattatggtgaaatataaggccaggcgcggtgactcatgcctgcaatcccagcactttggaaggctgaggcgggcggatcacctgaggtcaggagtttgagaccagcctggccaacatggtgaaaccttgtctctactaataatacaaaaagattagccgggtgtggtggtgggtgcctctaatccagctactcagggggctgaggcaggagaatcacttgaacctgggaggcagaggttgcagtgagctgagatggtgccactgcactcctgcctgggcaacagagcaagactctatctcaaaataaaataaaatggaaatatgttttaccatcttaaccctttttaagatcacagttccttgcgaccatcgccaccatccagctccagagcttttttcatcttgcaaaactgatgaaagtctgtccccattaaacactcactccctactcccccttccccagcccctggcgcccatcatctactttctacctctgtgaatctgatgactgtagcgacctcacgtgagtggaagcagatagtatttgtccttgtgtaactggatcatttcactgagagtaatgtcttcaaggttcctccatgttgcagcctgtgtgagaatccccttcctttttaaggccaaatcctattccgtggtagggagggaccacatcttccgtctccgtcggtgcactgagggacactgggctggttcccctttttggctgttgtgaatgttgctgctgtggacatgggtgtgtatggatctcctttaaagagaccggggacagactccaaagtggaattgctgggtcatacagtaattctgttttttttctggcatgttatttaaacagactatttgttagagcagttttaggttcacagcaaaatcgagcggctggtcatttcacgctttaaaggagctgtggcattctacatcccccagcagcacacaaggtcccaacttctccggatccttgggagcacttgtcactctgtttggggtggcagccaccctaatggatgagaggtggcatctcgttgtggtcttgatttgcatttccctgatgattagtgacactgggcacctctccgtgtgcctcttggccatctgtgtatcttcttcacagaaatgactgtccaagccctttgcctattttttaaaaattgagttgttaggaactttggttttttaaataattttaaagcacacaaataagacacctgagagccaacttataacacgccccaggatggacatggattcacactcatggtagaacagagctgagggtgcagtgtgggatgggctgacttgtggccaggggaaagacccgtggcctatcttgttttggggggcagggacccagaaactcattgctttcaggccttgctagaaaagcatacagtcgaacgagtgggtccgatgtggagtgcagtggcatcagccaaggctccgaggcgtttcttcccacttcacatgtcttttctgttgtttctgcgaaggtgtctcagggaggggcagaacccatggggtttggcttcctgaccctgaacgtctttgtcccaggcccttcactgggtctggaggaaggagggtgctgtggtcctggtggctcttgtgcctgcacccgccttggggccatctgacacccacaccctccctccaggccagacccagctctccagcttcccggctgcccactagatgaccaccaaggcagggcggctggtggtgctgacggctctgtgaggcccaggcctgtcttccccacctcaccccacagggctgagacacctccctgtcccctggcagggctggaggctctggagtctctcttggttaccctctctctcccagggccacttttgcagcctggtgtccttatctcatgtctgggtcccctttgccaagggtcctccagcctttggcctgcacccactcatctggcagtaacagggccacttccagaaccaccaccatgcccaggtcatgtctgtgcatgagagtggtcagccctccatggcaggcctggcctcacctgccagtgtcctctcccacacccgaggacacctgtaccttgtcccggggcggggctctctctgccatggacgccagtcttccctcccctaagctgcgggtgacctgacctagttgagcctggctttcctcctctgtaaaatgtgaacagaggccaccacccccattatgtgggtctgtgtttgctctgtgcacgtctcggtgcccagatctgaggcccttttgtccatgaagccatctgcagccaggaggcggccttgctttagtctgaaggagagtgaccagggtaggaggggcctccttgtccctttggtctgtttgtggtctcagtggagaccaaggacggctcttcttctcgtatctacggggcagagctcagggccgcactccatcagcatcccgggccattgcatccttgaccccggggggcttgcaggcaccacatagatcttgtgagaggcgctttgtggggctggatgatcctgggtgcccctcagagaaggccctggggctggccttgttatcagtgggggagtcaggaagtaccccggttctgtacctgtagtggatggggctctcagagggattgggggtgatgggggtgctgagctggcctgagaagggtggggtaacctagggggtggagtgggggagggagagagcactcctgacacagggtcctgaggaggcaggggtgccccagggaatggggggcacctggggcccacgggaggctctgggggagactgggcggtgagcccctgggaaggaggcctcagggacagccctagactgtcaccctcagtgtggacagcaggagctatggcagctgcttgagcaaggtgggcaagggagaagtaccaaatgtgtgcaggttctggggaggagcttgaggcccctttagttcacctttggaacttaggaccaagtctgcaaatacagatgaacccagggttaggagggtggctggggcatcacccacctggggtctggactgctggaaccagggggaggcaggcctgccattctgtgagcctgctttagactggggatgtggtcccgtgaatcaggggtgggccatggcatggcgtgggggaccagccctcctccctgtccccagctgagtgtgagctccctggggtcttgctgtggccttggccctgggtgttgtcccacacagcccaggagagcgtttgaggctgatggtggtggagatagttttatctctgagcaaacattccatcttgctgtttccagcctagagatggtgaggggacttttccttggctctttcctggcctgctagcagcaccagcctaattaacctgacaagcggggcctccccagccatgcagccttgcactgccttcccacatccagctggatttggggatcagtgttgtttttaatcattcctaccaccttgtcccacaggcaggagtcctgccatcttcgaaggccagcccctaaacaggttccctgagtgttaggtcaaaataactttaaaaagacacgcagctatccacagcaatccttaatagttacttatctatttcagggtataacataagacacacctatcatttcagacctgcctaggacatgcctggagaaggtatttaagtaattttaaaagtgcatcaaaacaaggtcaggcgcggtggctcacacctataatcccaacactttgggaggccgaagcaggcagatcacctaaggtcaggagttccagaccagcctgggcaacatggcaaaaccccatctctactaaaaaaatacaaaaaaattagccaggcgtggtggcatgcgcctgtagtcccagctactcaggaggctgaggcaggagaattgcttgaacctgggaggcagaggttgcagtgagccgagatcacgccactgcactccagcctgggtgacagagcgagactctgtctcataaataaataaataaataaataaataaataaagtgcatcaaaacaagaaaaaccctgctaagggccagtctgctgggtggtggatgggtcagcagagctgggctgggagccgctatgcctccccatcaaggccaccaatagtcgggtgagccggcctctgtgccgtcatgggcaccctgtctcagctccggggacttggagctctgtgtttccgtggcctttttcacgatgaccaaacaaaggcgggtgttatggtgtccaggcccggtctccctaacgggcagtttctcagaagcaaagaccgacgagacagagctcctgctaccagagagccctaggccggctcattggaatagtcatttatttgttccttcattcgttcattcagcatgtccatgttgagcactgactggagcaggtcctgttctggggcctgggaaatgggggtggataagaccaaggtagcctcttctctaaggagctcagccggacctcagcctagagccctggtccccaggagctgaggacagaggtgggacccacaccccccccatgaggccacagagcctgcaggtgtccacaccttttgtttttgttttttgatttttgttttttgttttttgttttttgagatggagtctcactctgtcacccaggctggagtacaatggtgtgatctcggctcactgcaagctctgcctctcgagttcaagcgattctcctgcctcagcctcctgagtagctgggattacagggcgtgcgccaccatgccaggctaatttttgtatttttagtggagacagggtttcaccatattgatcaggctggtcttgaactcctgaactcgtgatctgcctgcctcggcctcccagagtgctgggattacaggcgtgagcccccgcacctggcccacaccctttctttaccttacacccctgccatctccagtatgcacctgtccgcacacacccacacacccctgaaggatttgacatcatgagccaaaaacatttttgcaaaaggaaagcaactaagctcccagcgtgtctccccttatccattgggcttgtcccaaacacatgccggatggtgtaagtatcattccatcctaattaataacatttgggagccagcgatggcagtgtccagctgactgctcatagtggactccctggtgggggcgtggcatgggagcaaggccagccactgtcacccagtgggagcagaagtcccctccagggcccggcttctgagggaggacaaaaaagagtccgcaagaagtgggcctgagacgccgtatgcctgtggctttgtggctttgtgtggctagcgcctctcacacgtgggggctggtttcatcttccagccccacacaccttccccaagggcctcccgtacaccccggctgcctgggcgctgggctccagcctgcaggtggccgctgcactttaagtgtcacaatgggctgcacttcacatgaaagctgcattttggcaataagtccccaccaagcccactgagcctggccctgctgcatccacactatacagctgaggaaactgaggcccagctttccacttctgtgcctagggggtgggatccagctccgaaggtcttcttcccactcctccaggaacctccgccctctggtgtcggtggagttgaggaggtgttggggtgtggaggggccaggtgactccctgtaagggcaaagtgatccagaggctgcccctaccgcaggtacaccaggctcaaaggccagctgtgaggctttccggggctggatctggtgggaaagtgcttatcacggagggcacccggggttcctggcgtgggaccccctctgacccaggctagggttcctggcgtgggacgccctctggcccaagctggggttcctggtgtggggccccctctgacccaagctggggttcctggcgtcggacgccctctggcccaagctggagttcctggtgtggggccccctctgacccaagctggggttcctggcgtcggacgccctctggcccaagctggggttcctggtgtggggccccctctggccaaggctggggttcctggtgtggggcctcctctggcctgggtgggcctggcctgagagctgcagcctcacctgggctccactgcctatggacatgagctgaagctgctcagccttccggggcctctgtgcgcaggcatcaccatccgcagcaggccaggacccgggcctgctgttctcagggtgtccttcagcggaggctccagcatggctgggttcaaacaggttgcagggtctgaagccactcaaggccgagcctgcctgcagtgagcgtcccactctgtccctgcaggagatcgtgctggtggtgttcttccggacggagtacgtggtccgcctctggtccgccggctgccgcagcaagtacgtgggcctctgggggcggctgcgctttgcccggaagcccatttccatcatcggtgagtcatgcctgccctgtggaggtcacgcccaggtttccagaccaggaaggacccccacctcatgacccctaccagatggagtcccctaaggactggggaaccccaaggccagcagggggtgactgcccaggacccagcacaggagcattggcagccctcagcagcctctgcactcagacgctgatcatggtgttgggggtagggggttggtccctcacagattcccatgagcctcacagcccagcatagcttcatggtgggccagtcaccctcggcagcctgagaaccatggtccaggcctgaggccctgccctttctggccacttgcagggctcagcacagggcccagcctaggccgggggctccacatggccaggacagaggttgggtctctccgtttagatgctgcctgcctccctatccgaggtgtctccatttccccggtcatcagggcgtgacccgtctgaccagcaagccccttccccagacgagagcagggtgtatgctcttccctggggccctggctgtggcgatcacgaaaagctccccctctcctgcactccacagacctcatcgtggtcgtggcctccatggtggtcctctgcgtgggctccaaggggcaggtgtttgccacgtcggccatcaggtgcgtctgtgccacaagctccccccgccatgccgccccaccccgagcacccctcctgagccgcgggtggtctcacgccccatccaccttgctcagatgcaaggtgccttggtgcccactgcccccgggggcactgagccatgtgctgggatgggtggagcagggtgggtgcaggcaagtgtggagggcacggctcaacccaagatgcctcaggcagccctaggctctggcccagcactagcgcctctgaacttccaggacttgggtggtaacctgaccatctgggcacacagcctgcccatctgcaaactggggtgacccaaggagccccccagaaggcagtctggggactgagggaatctggaggtacctggccgacccccagctcagccctgtgtgggcagattcagagcaggctctggggggctgcgcctgagagggagattcccaggcccctgtcgggatggacatatacccagcctccccacccagagtggacgcctgggaggggcaggggcagggacacccatgccatcggccagccctaggcccggcgtgaacagctgagcccagcctggctccctcagccccacaccatctccttcgcaggggcatccgcttcctgcagatcctgaggatgctacacgtcgaccgccagggaggcacctggaggctcctgggctccgtggtcttcatccaccgccaggtgggtggcccgggttaggggtgcggggcccaggttggggacaggacggagggagcagagcagcccacactaggacagcttgagatgcgctgaggccccgggggccggtgggtgcctgggcgcaggggtacctgaacggggcccaggatctcagagcaagcccaagcttgagcccagcctggatgctccaccccagcctggtgccagtgaccctggcctgccaggctgatggtgtgctcaccttcctctgagctgggggcaaatgaagacagaaagtcagaaatgaaaaacccaggcaaatcaaggacccggtcaaggcagggccaccagactccctcccgagggctgcactcagatgggttcaggctgcactggcccctggctctgtggggtgaggggacccttcctctccctgaggatctcctgggtcctggtccattcttggttctgtcacgtggcaggaaagagagctgggcaatcagtggagcccgcgccggcccagacagtgggcctagggcgaccccagggctgagcctcattctgggggtaacccccacccgccacttaccggagttgtgaggagtgggctatattgaagccggccctgtgcatgtgaaccgcgctggagcggcgtaggacgcccagtgatcgctgggactcgctgccttaggcgtctgcacaggaggctcccagcctgcggttcctggagcccgacactgtgtgttttctggcctaggagctgataaccaccctgtacatcggcttcctgggcctcatcttctcctcgtactttgtgtacctggctgagaaggacgcggtgaacgagtcaggccgcgtggagttcggcagctacgcagatgcgctgtggtggggggtggtaagtcggaaacttccaggcatggggacaggggcagctcaggctgaggagtgggcaggacatctgggcactggtgtcttgagacttcgggccttggcaggggcttctcacctgcacgctcacaggcctctgtccacaaacctgtgcttggagccgctggcacaggtccccacgctcagtgttgagtcctttggcatcaccatcttgaagttctgaatggtctcatccttgaacttgagatttgagagggaaatcggaggggtcactggagcgtgtgttgggggcttagcggtttcggctcccccatggctctgcctcccgccatcgtcctaggttgcccattccctgcctccaccgtggccctcaccctggcagggcccaaggagagcggcgtcagatgcatacctcgcgtgtctctgagggtccacacaggccctgtaagtgcccctgtccccaaggagccagacatgagacagcaaacaggaaagaccatgatggctcaagagaccccagcagagatcagagagcccccgtgtttccagtggatgctgggcctgcaagttctggagccgggcctgggcagtggcgacataggtgcagctgggcctagggaagcagggacccggcctgtgggcccagaggctgcccctggctgtgaaggtgggttccggccacctagagcagcccgggagccttggggaagccggtgtgcagcaggcagatcccgcactggaacaccgagccacccaaagctcagagaggctgtgcgggaggggtggggcagggtgtcttgggccgtgtctgtgggggcttccttgagggactcaggcttgcacgtgggagagggagatgttccgatgaggatgcagctgcaggaatcagggtgcgccctccgagctgcaggctccccaagtcccaagtcactggcctgtgggcccagcagcagtttctcatggctcagaggacgctggctgaggcatttttagggggcaggcctagcttgccagtgtccctctgggagctggtggctgccttcaaatcctccagtgaaagtcggcgtttatatatgcatggagctcaagggctgcttctagggggaacacgtgggtaccccgaggggagtagctggctggaggccagagtgcagggagggaatgactccatcccatctccccccacagctgcagggccaggtgggccgtccacaggccactaaggcccagggtggcaccatcacaccttggggagtggccctgggtggggaccgagaagcccaagtgccgaggtgacagggtgacccctactctgccgccacaagcctgcccccgcgtctgcccttgtctaccgacctccgggctcactcagtccgataacaggttagatggaatcgtggtagcaacaggggctgggggctggggaggaggccgtcgaagcccacacagggtgggagccaaggcctgggggccgcacgggggctggaggtgggggcgggcagggcagccgtgggaaacacgtggtggtgccaggacccagtccgtctgccccgagtcctccttccagaaaggaccggacttgctggctctcgggaccccccaccaccatcagagcatatctgggtggggtgagaagcctcccggtggctccccaggcaggcacgtgtccctgcgattgctgtgcctcctccctccccctcaaccgccgcttcccccatgaggccagacactcagcagtggctcctgacgtaggccaagtcagcaggttttctggaagcttccaaagtgctgcaatgctcagggatggcaggggcatgctgacacagctcctgggttggggcaggccccactttcggcctcttcccgccttcctgggggcctgtgtccccgaaggccccagtgtggcaggcctgagcaggtttgggcagcagggcccagcccccctgcgggagcctgcctgcagtgagtgtggatgggtagggcgtgctcgggggatggacggcccagagccaggagagttcccgggaggctggtggcaaggtgggcagtgaggagctggcggtgcagcaaaagccagtgggtactggccccggcacggctgataagcagtgcccagccttcgctgctgccctgcctgccttcccagccgcccactggagctgtgggcagcggacgctactccccagccccccagcccgcagcagagcggcactcccactcccacacctgtgcaaacatccgcccgctggccgggaacacggcccctttgtgcccggcttggcatcagtgccccggcccacaccgtcagctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaacttgagaaacgcaagaaggggcagcagcccagatgggggcttttaagccagttttgccaatttgcaactgcgccctgagcagttgttttctttcagctcctttgtcctgcttccttcaccccaccggggagtgaagtacgccctcgccggccaggcagccagggctgctccatgtctgtccgtccgtcggggctgccacaggcccttactgggtgggaggtggcttcctggaggccaggccattctgatcatcatgctgcatctgccccagaccttgcctggactctgtggactcctcacccctcagacacaccctgagagggtgctggagctgccacaacaaagtccgcgaactgctgggcccagagcaacagaaactcatgggctctagaggccagagcccgaagcgaggtgtgcacagggcctgcccctccgaaagctcagggagaaatttcctctcctctccccgtggctggagactccaggcgtgcccggtgtgcggccgcctctttcctctgtgtcaggccctgtctctcatgaggacacttgctgttggctttagggtccacccaggtgatccaggaggagctcatcttgattgaatcttcaaagagcctatttccaaatatcgcattctgtgggtccaggtgaatatgaattaggggggatgcagtccagcctaggacagtgggtggcccaggtggacttcctgggaaggtccctccccttgccggccaccagtttccacagctgtccagcgaaggcgccggctcagtggttgagtgtcccctcctgtccccttcgccggggtggggatacgcaacttggatgtgagaactctcgaatcccctgagtgtggcgcctgccctggctgccaaggcgtttggggagaatttaagacttttctttgcccttggaacaaaatgcgtttgtttgtgttaaagtttgagtggagggagaagcagtttttgcaaacacgggcttctctgttcagcgcccgggggtctctacaaacaggaggctgccgggctgtgtttgcccctctgcacctaaatttagaattgaaagtaaagaagctggaaccccattcctacatttcagccgccttttgaagtcgagtctgactgcctgctgttcactctctcctcacctggagcctccagaaattcccgcctccctggcaacgctgcaccctggcggggcaaggccagaaggggctgggggctggtgcaggggtgtgcgtgagggcagggcctcccagacagtcacaggccagccctgttggcactgcccagcgggaggggtggtgtcaggaagagctggggaagccaaggcgccgtgggccgaggggcggcaggacctggccacccaccgagcccctgggtcagcgttcttcctcctcctggagttccgtgcaaaggggaacgagttcagctgccctactgagtgggcctggggacagaggcagagtacgcacctgctgtgtgcctcagtttctccatctgcacatgggagacagcagtccgtctcccagggccaatgcagggcccgctgcaagggctgctgaggactgtaatcccagaggctgcaaccgatccctctgctgcggagactttccctggaccgaaagggcctcctggtgaggctgggtctccgtttgtggactcactgttgaggcgtgtggtttgcggtcctgctgtgtgccaggcaccggcaggggttcgggcagccctgtcttgctctctctgtcacagtcaggagcgagaagcatggtgtgagctggggctggcctgtggtggttcgcaggtggccatgggaagcaccgccggagtgtccctgcaggactgtttcggcccaggagcagggaggcctccttgaggaagtgacagctgagctgagacctcaagacacagtcacctgggccaccttccggcagggcgctgagcctggctgtacctcggggaagacgcggcctggggcctgggtgccatgggggtgttgacggtttcaccaccagcccgtgtgtggggctccgggcttcgtgagtgaggagaggactccatgtgacggggaggcctggccctcgtgaattggtgttcgtttatttactttctcctgctgaaaggaagcaggtttattttggggtgtgtgtctgcttttgcttttaccctgagagtttgccagcctgctggcttgttcccccacccccacctggtggcgtcagcccctttatggctgttcctgagagacaggccggagtctccagggcggccccacgggggctgggcgtccccttggaatgtgagtgcctggcctgttagagccccaggaccgctggccccacccttctctgtcccagagacagtcctgccccccacccaggggcctccctctgtccacggctccccctttcccaggccacccccctaggcccctttcctccaccttcattggccctgccctctgtagtgtcacccaggtcagtggggccctgtcctgccctgtcctgaggagtgcatgtctctgagccctgcatggggggagcccaccagctagcagaggcccagaaggctctagacaggctctagactgggtctctaagtctgcaaggggcaccaaagcactttacaaattccaggagtgagtgacaggctggccacgtgccaagccctcacccagcaggcagcccgtgagaagtgtgttgtgatcatgcaccttcccgagagggggaaactgaggtacagaacatgctggggctttgcctgaggccagacggacagggtgagaactgccccccacactcagagccacggtgccagcccagccttgccagcagggcagccacaggacttccaggcaaggtgacggtgccaggtggggcccgaggccctcactcatagggcattgtcccacatcccctggaaccactgagacaggcatcgtgccacgagaggggacacctgcctggacctctgtgtgctcagcctactgggggcactgaggccgagggcccagctctgcgagatcctgcatgggcttccttccaagccctggagaggggagcaggcctgggagggcgcccttggcccagagcctccatgaagagccaggggcctcctcatggctggggccccagcacagtgacctgggaatggctgtggccgcatgggatgtcccggagcccctgccgccctccttggagctgtggggctgagcttgggtgctgcgctctcctgactccatccttaggtgcctcctcacgggcaggctgggctctcgaggctgggcaaggtcggggcctgcaatggctgaagcagcctcttagcccatctctgccttcggggtggccacagcggggaacgtgggtcctgcaggccttggtccagctgtctgcctggccactttctaatggggagccctcagcacagtgactgcccagcctcagtttcctccttcgtagatgatcttgacctgagagtgccagctggggtgtgacacctctgggctaccccctcctcccgctcttgaccaccccttcctctggacagacgaccaccacatctccagccaggaccaccccttccttctgggcaaatgactaccacgtttccagccggggccagtgagctctgggagccagggcttggcatgcggctggagctcaggtttctgggctggcctctgtcctcccctcgaggccagccttgaggaggctacttctgaaaggagggaatagaatcccagtgtttctcagggaggaacatggggggactagaaggctccccatgcctcccgccccttcacatgggagtgaaggcacaggccagcaggagggcgggggaaacacactgaccagtggggtgtgcgttccccgctcgcccccacagttcctgccatgggcgtgactttgtgtgcctcatatggctggtgccctggcaaggagccacggcccaggagacagacatgtggatctgcattccaggtggtgggccatcagggactaatccccagcatggtgaccataaaacagcccattcctgagctgcctgtgtctgaatgcaggaaaaacaaacaggtctgcagggaggggccgtttccttgttaacttgaggatgagggtctggggccgggtctgggcagacaggcagaccaggcgaaggtggggtcctggagctgcgtcctgctgtatgtgtgctctccacggtgggcagacacccaggggcacttctggggctggcctttctctccctctcggggcacccctgccttctactgaccacccagccagccagcaggagcccacgtgcacccagctcagccccaggaggtgacacccccaccctcagcagctctcgtctgtttgggggcaggtttggaaggtggtctcgggtgtccttacgcgagcaggtggctacctcacctgctcacctgaccccaactccactctgacttccaggccagccccactccattccaccttcatcatgcagtttctgtattagatttttaaataatcaaaatatggtattttcatttaaaaagtaatgcttttaaaatatattaaaataatttaatgttgttattagaacaatgtttaatatgccagcccgtgccatttgtcttgatgcctgggtttgctggcgccccttacgcttggcacgcaaggcaggagctccccactggcctcccccaactgcttgccgcccagcccccctcaggccaattcctgcctctcagcctatcttgggtttgtcctcggctgcctcgggaggcagccgtgcccaggcctcttggtctcagggccccttggtgcccctgacggagaagcctggctcgtgggcattgtgccatcactatttaatacagtggaggcatgtaaaaacaattccatattaatttattaaaataatagacccattacattttcataatgtcatgaaaaatttctatattttccaaaacaaatattatcgaaagaaaaatatgcatttttgcaaatctccagaaagcctggctccccagaggacggggatccccacgcctgtcccggaactgtctgtgaagagcaacgtcccactgcttacgcttgggtgggagcaggagtgcctgttagtgccccccagccacagagagtgctgccgtccctgagcccagccccagcagatcatcagcacacatttgcctggggaacacagacagccctgtcctggacgcagcccttcaaccctgcttctcatacctgacccccaccttgggcgctggtctgccacaccccaccacccctgctttcttcagcctgaccttgtcctcccggacccagtgctaggaggatgtccaggcggggtgggacttgggcctgcgctgggctgctcctcaagtctcgggctgcacgtgccagccaggcagacggtgctgagaggggcccttctgcagagcggaggcagagcccggagtggaggggtgagcactgcctcagggcattggcaggggctgcgccagcccaggcacaggtctgagggatgaataggaggttgctggatgaacaagtaggaatcagcatgttcatactgaaggggtgagtgtccccccaaaaaatctggattagacagactctggagccctcttgctccaggttgcaggggccctccgagctcaaggccaggataggccagggtccctgccctgcccaggcccttctaggcccgtttctgggccacctgtgtgtgctttcttggacttgctgtagacttggtaaacagtggatgtgctgggaccctgggctgagcccctttgggctgagagctcaccaggtggaagtcactccccagggcaggactggcacagggtctccgatgccccgcccactttgcagccctgtgtctgcctctgcaactccccaccccagtgcacctgggccctctggggaaggtagcggcagcccagcctgtgcatgtgggtgcatgccctctggggaggacaccctgcagacgaggggctccggttcccccatggcccccctctctgccagccactgtcagcctcacccatggcctggcttcaccctgcagggacctggctgcgctccgtgtgcctgcgctgtgcgttcaaggtgtctgcacctgaatgtgccctgagagtgtcaggctcggacatggggaccagctcccttttcacatgaccttgtcatctgtgtgacgcacgtgcgtgtgccgggtcgtgtgtttccgtgtgtgtgtgcacaagcacagacacgtgcacgtgtggagcatcccatctctgcatggggcacgcttgtgagtgtgcacccacatacacagagccgggtggtccactgaaagggcctggcagtaaacagcttcctgtgcacattgtgtgtgtggcaggggcatgggggcatgtgtgtgtctcttaaggacagtggcgctgcagggagagctccgtgtgcagctgtgggaggtagcctgcaagcagcctctgcagaagcatcctggccataagcgaacgtgcggtcagggcactagtggggcaggggcctgggtggcggccagggctcagcagaggcctgtcccgccctgtggcctggcggcggtggctggcgttcatcactgttcgttaacgtgctcatcggtacagcctggtttcccgcaatgtggccgcttctgctacctgagcctccgagcctcctgctgtggcagttctgggcagtcgcgtgagccgtagtgcacctgcctctctgtccgcgtgggcgcatgtgcacccctgcccgggggtggccatggggcttctccccaccctccctcctcctcagtggctggtggaaaccacagggtggcccagggaccctggtcctcgtgggggctcaggtgggccggggtttgttcttgccttccatcagagtgtgttaaacaggcctcaggccttcctgccatcagcactgggcccatagggctgggaatccagtgggggtctccatgtggttcccagctggggcattcctgggcctgcaagcggtggccgtcacttgaccttgaccagaagccccaagccggtaaatgctgtgctgtcctgagtgtggtgcccagagcagggctgcaaagacctcccgcagccacagccatggtctgggccaccatgcctgctgtccagatgagcccaggcaggagcctgtgtgtccacagggtgagctgtgcctgagggccactctgggtctccttgttgggctcagcgccagctcctgaagaacccagcaggcagcctgcacggaccaggcccagccagggtaggctcctacgtcctgcagaatgacatttccaggctcagactggaatccccaggaagcaaacctcagatgccagcgcgggggaaagggtggggggagccttctattgtcccaccacacgtcctggacggatggctctcccaccaagaagaaggcttgagctgcatcttgtactctcagaaaagaggaaaataaaacatctggtgccctggagtggcgtcaggaagcagcgcgtcatcccagcccctgctctttgttgacgaccagcctcagtgggagctcccggtctcctgggggccggcgcacagcaacgtcggtggcccaggggcccagcctcctggggacaggcaggcagatgaggcagccggtgtggggcgagctcccaggcccacgttcccagccagcaggcctggcccttcgtgggtgctgggctccttacatgtgctggtgggacataccttgtgtgtgacgccgagagcctgggagacatgtgccatcccgcggctctgttcctggtgctttcgccgagtcacacggggtcgtcctggtggtcagggtctcttgccggcctctccgctcatcagagtggtgggtttgggttaggcagttggccctcccgaggctccagtcccatccgtggctgaccactgtccctctccctgcaggtcacagtcaccaccatcggctatggggacaaggtgccccagacgtgggtcgggaagaccatcgcctcctgcttctctgtctttgccatctccttctttgcgctcccagcggtaggtgccccgtgggtgcgttttccctggctccttggacagctggggtcctggggtggctgcacgcccctccctgtgagcagacccacttacgttcagaaccaagagggtgcttcccttctagaaagtgctatactccagagccccacctgccctccctggggccctggatgcagacttcccgtttgcagtccccactggggtccttgcaggcagtgtgggaggcagcctggagtggctgtgcatgggcgcagtgtggggcaggcctgctcactcagccctgggtgggtgggcaatgctgctaccacgccccatggaggcagaatcttgtgcctggagagggcacttccacgctgtggctgggggggttttgttccatgtccttccagtaaaccacagattgtaaggtgatgtgtctagttcacaatgcctgtatgtgggtgtgtgtgtgtgtgttatgtgcgtatgtgcataatatgtgtttgtgttgtgtgtgtataattttatgttacctgtatactatgggtatgtgtatatgtatcacatgggtgtgtatgtactgtatgtgtgcgtgcatactgtgtatacatattgtatgtgcatatgttgtatttagtatgtgtgctgtgttgtgtgcacatgtatgcattatacatgtatatcagtatgtttgcatatgtgtatttatgtatctgtgtcacaggtatgtatcctatacatctatgtgctgtatatgtgtgtgcacatgacatgtagacatgtgttagtatgtgcttgtgttagtgtttgtgtgttagtgtgggttagtgtatgttttagtgtatgttagtgtgtttgtgtgttagtgtgtgggtttgtgtttgtgtttctgtgttagtgtgtgtgttagtgtgcgttagtttgtgtttgtgtgtgtatgttagtgtatgttagtgttagtgtgtgttagtatgtgggttagtgtgtgtgtttgtgtgttagtgtgtgtgttagtatgtgtttgtgttagtgtgtatttgtgtgtgttagtgtttgtgtgtgtttgtgggttagtgtgtgttagtgtgggttactgtgtgttagtgtttgtgtgttagtgtgtttttgtgtgtgttagtgtgtgggttagtgtttgtgtgtgtgtcagtgtgtgtgtgttagtgtgcatatctattgtgtgtgtgtgtgcatcacacatgcacgtgcaccacgtgatctcctctgtagacacggagttccctagcttcagggtgggtcctttgcatcccatcaaccgtccttgggcgaagcagcagcagggtcctcctcagctgaagactgccttctcacttgcgaccccaatcccagtgcccagtatgaccccttcctgggcacatacagatggaccagcccacctggcccccagaatggtccctgggaatgggttagagcggctgcagccctgccccatgggactgggccccttgctggataagacctggggtataagttctgccccccatgctggcccaggacaggcaggctgggcccgaggtgggacttgggggggcttccagcactgaccatacctggccttcccacaacggtgaccggtaaccacgtcctgaggctgcacccagctggcagtggcctgtgtggacgggagcctcctgtccattccttcccaggggattcttggctcggggtttgccctgaaggtgcagcagaagcagaggcagaagcacttcaaccggcagatcccggcggcagcctcactcattcaggtgcggtgcctgcaaggccctggtcactgtcattttggtcactgttattgttgcatccagccctcacggccacctgtcagaaccatcattggcccctgcatcagcttggctggcctgtggggcatactctgcttgtggaaagccttggctgctgtggtgatggggtgagcacggggcattggagcctgtcttcctccaaagctgctcccatcaagggccatgccctgtgggctggagaggaggcacggccgtggccatgccaggagtggacgtggttggctctgaggctcccttgtgctcccattctccctcccactgcacaacaacctgagggctgagtctgggagtggggtggccaggtgattgtccccaagggaggtaggacccagctgtgcagttggtgccttctggagggcctggcatccctcagggctcgggaggccctggtgcctggaggtgaggactggcgatggatggcatgggcctccctctgggctcacaaggccagtgggctgggaaaggcagagccctggagcaacaggggcaggaaggttctggaggcaggtggggaggcaggcagtaccaagctctgggatgctgggctctggctctgtcactccaggctctccaggacccaccagagaatgggactgctctgttaacgtaagcaaggacttggcacaggagtcacttgagaattgcgtccctgtgggtctctcttgttggccactgcagggccagggctgccctgaggaacagccgctgaggtgcccagagggtgggcgttgccgggttgaatgacaagtgcccactggggatagggcctccgcccagtgcagtggctgggagcacagtgtcagttcctctgggcacactgggcctgatgtcccccaggaaggcccaggacctgggcagcccccgctggctggcgtcccccctgcagtcctcgtgagctcgctgccccaggcaaggcccaggctgtcaggggccagtcgcagtcctcctgcactcctggctcagccatcgggggggctgtgtgctcccacccttagcctggttttatggcttcacagtttctccttcctgggagaccataaatcaggcccgtaaacccgccttggtcccagcatgagcatgctggccgcccacgcctggcaggggaccacattggattcctggtcccactccctgggaaccacaggtcctttgaaaggggttccctcggaagctgcacacactgtgggaggactggagtaggggccccaggtggcaggtgtgcacaggagcagggcaggggtcatggggtttgccagggttgggggaccacgtggagtgctcagcctgtgtgtgtaacactcgggccttggaaggctgggcttgtgccctcgcctgcctgtccctgggtgctggatgggagtgagggctgcaggtgcccctcgccagctgctgtgtctacctggggctgtcacccaggagcccatcagtgtgggggaacattctccactcggccctctctcaggctcatgtggccagtgatgacaaggccaccaggacatgtcctcatacaaggccctgggagcccctcctgcccatctggacgctgcacaactgctcccccgccgggtcccctgccgatagtgtcccctcctcccacccttcccttgtggtgctgccatggggtctctctgaaatgctggcttcagagctgcacccatgtgccatcagaggctcccccaactgcaaggtggtataggcctctgggagagacctcacctcctgccagccctagggatcctgcctctccctgccccctgctcagcacctgcaggtcctgggcgacccctctttctcagcccttcctcactgtgtggccactggttgcccatttccgcattggtctcctatgcacgctgtgtaccctggcacctggggatgatgtgcgacctgcccacctttgcaagtctctcctttggctcaaggctggctcagggctggtaaagacctctgtggtgtcccagctgtgggtaacaattagcccatgaggcagtgagctgcctggtgcagcaagggaccaagccaggctgcctgggcagagggtctgggagctgggaccatgtcaagcctgtgactctgaggtcccagaccctgccacccagaggggaggggccaggcctggggaacagggagggggagctgtagcttccataagggcccccgccgggtggctcagcaggtgacagcctgtccccctgcccgacctcagaccgcatggaggtgctatgctgccgagaaccccgactcctccacctggaagatctacatccggaaggccccccggagccacactctgctgtcacccagccccaaacccaagaagtctgtggtggtgagtagcccacctgccaccagggcagggccttcttgctagcaggtggggaggccgtgggggccgcagcacgaggctgggatctcaccatgcatttggcttggtacagcctgtgtcagggagtcagcatcgttcgggacactgggccatacacccgatgctaggttcctgccatcccaatgtcccccgacttgggggtatgtaggaccggtcattccagggccagggcatgagagctccagagatagagctctgggagcaggacgggctggaaagaaggctcttcagagggcctcagggttgggctttccacaccgggcgcagtgggtggtgagcagtgggcagggggccgcgcgcagtgggtggtgggaggggagcagcaggggagggaggtgaggcaggggtgcagcgaagggggtctggaggtcacagggcagtggagtttggcaggcgctgggcagaagtcttgtgacatggctggggtcataaggggttggggctgacgctggcatggttccccttcctggcccgtgcccaccccctgtggagagacctggccttcccagtttccagctgccggtggagcctccgtgcctactgttccctgtgctggaatgttcccccagatttccacacagcctgctccctcacttcaggcgccctcttcatgccctgctggcccccagcctgttcccccgatatgcattctcccctactggtcacagcccctgttaccacctccactggcaccatcttgtacgtttatctgcttcctgctgtcctgttagcgaggccgtgagctcacagggcagcacctgggccaagccccccacgtgacccccagcagccctgccctgtctctgtgtgaagacactggagctggccccaggcctcaggtccctgtccgggtgtatgtggcgggggctgggctcggggcggctgcacaggcactctggggccggcgtagggcctggcagacgatgtccaggaaccgctaatctgttgtcttgttttttttaggtaaagaaaaaaaagttcaagctggacaaagacaatggggtgactcctggagagaagatgctcacagtcccccatatcacgtgcgaccccccagaagagcggcggctggaccacttctctgtcgacggctatgacagttctggtgagaacccctcaggcagttgggggccgcggggccgggaaggtcactgccttttttgggagcccgagcaagccagtgagtttctcccttgggctgtggtctctgacaacgaggtatgaacagacagagggtggagcttctagaaacttctgtaaaccttccaggtgccttcccctcagagtcttcccaaggaggagctggccacgccttctgttgcgagaggaagcctgggcaggtgatggggtgggtcggctccatccggctgtactgagggaagggtgtgttcctgattccagctgcctggcttcctcccagccgagcccacgggctctggttggaaagtggctagggtgacctctgggcctactggcagggacgccagagggaaggggtttggggatggggccctggaggagcagcaccaggcccgggtaaaacgtggggggcctgacgggacaggcccttctcatgcagcccaggggccccgagtctgtgcgtgatggtgtggctcggatctgcgtccctcctctcacccctgcagcgggggctgggatgaagctaccttctgcgggacctgacgattggatggcagacctgtctagggtttagatgtcctccatccctggtgaggggttttacccacgctaactcgtaagcgtggctctttgacagatgtggagagcgaggccctagaggctgggctcgtgtgctccagccacacggcgggaatacagcagtgcccggttgtggctcccacgagtgaggccctggaggctgggcccatgtgcttcagccacacggcaggaacacagcagtgtctggttgtggcccccccatgcctcccgccaacttctgctgttcccagaagtgcagctggctgagcacagacacagcaggtgacctgtggtgatgccagggcatcagcgcttggcctccccacactgctccagggcagacctggcctcctggctgcatcaggaggcacacgtgatgcatccgtcatctcgggaccagttttgagacaaacatcctatagggcaggaccgtgaactgggtagctctacagagtgtgaggggctggagacctcctgcccactggccacggatgccacggatgcccttgagagttaggagaggtggaagggaccccacttctccctgggagctccaacttctcttgcatgtgacttcagtgcccacttctggggactgtgatcccaaactgccaaattctctagcagctctcttaaaaccaaatgtgaaggattctggctttttctgtcctctgagcccagcgtggggtatttgagatagctgtgctgccaccaggacaggggcgtgcaccttgtcttcccaggagaaaacacagcaaagcctgtttgctccctagtacctcgtgcaaaggtgccatctgtggccctgctcgctgcttcctctgaggcagacatagtagtgactgtgttctgatacaaagatggcacttgcccgatgctgcactgcagcaccaatgcagaggccctggcaaatgttcgcagaagcccccgtcccagggcgtggtcccccttggaggaaaagggcacctgttttgaaaacacttggttatcatggtgccagaaagcactagtttaggccccacatgaaacagtggccttgccctcccagcatgggagagccctcatcttccaggtggtggggggagcacagcatttgaagcccactcccctttgaccacttgctgttgtccagacagacatcacgcacgtgggccttgcattggttcctgcttactttgtctctgctgacccggtttctgctccttgaagtctcagcccccttcttccatgattccaaggcatgtccctctaaggaggcttgaccccaccctggagggcctgctccccactctctgccttccatgccccatgggagggctccatgtggcccagtcccttggaggctggaccccactgttccggactctgggctgttggaagccaggccctgcctcagttgtgccaagtggccagggttctatgcctggcagaggaggtgtgggaggccaagcgctgatgccctggcatcaccacaggtcacctgctgtgtatgtgctcagccatccaagtaatatgatccattcccttctcagcagccgtccctttaccctttggtcatttctgcatccatctctccctctcggacctcttcccagtgcctgggactaacccgaatgtctcagcttaccagcagttgtaaggatgctgtcacatcttatgcatggcagagaggggacaaacccacagtgttcgcaaccctttgtgctcgcaggcaccagcccagcccgccaagctccagttcattcaggatggctcacctgcatccccacctccttggcaggaggctgggtggtgttccctgccccttggggctttcctgggcatcccatgtggaagtcagcaggcaagaccaagtccaggctcccgctccactgggcaccaggctccccaggacttagatgccatcaggattgggctgggacccgaccacatctcagtgagcccccgggacgtgctcccgcctgcccgctggagccggcacaaagggcgattgtgccaaccaatgcccagtgcccccacagctccggattcagggctgagaccattgtctccatgcaaatgggggctttctgcgcatgctaacgggcaggtgggcgtggccgggggctggggacccagcctgtgtgcggcctggagaagcatcgcttgctgcttgctgaatgcggggcagcccgaatcgatgccgtccattcagcctggttagtgttatgaagtcattagtgctgtctgcggaatgttaatgaggggcaagtgcggagaaagtcaggcgccttttgtggaatgctcctccacggagaagatttctctttcctgctggagtttgttctttcctaacttgataagtcagcccaggctggaaccaccagctttctggagcctgagctgttggcctggcccccagggacagagcgacccctgataatccggagtcccctttgcccaggaggctcttggagagccctggcttggggagaaggagatgctgatcccagggcagatgccactcctggggaagccccacagccccactcccgcaaggcgggtacgaacagccacactgagtcccccgcaaagtcaaacccaggcctcgaccttgtctggctgtgctttctgttgtgtgaacctgcaggttaggcagaagtccccttgaccctgcctcagggctgctacctgtctgcgccatccacctgcacacaagccccttcagctcgtgctctagctggtgctgtgcggtgttggccccatttatagatggagaaacggaaggccagggccatgtggggaactcctgaggacacctgtgtgtcctgacacctcactgagcctgtcgagaggcacaggcaggtatggcagtggcagacctcaggggagggaggctgggaaggtagaaggtcccccatggtagcatcagaacacagactaacctgcagcaaaaatgggctgtgtggtccctgtagagcagcctcactgaggggaggcaccagccctcatcccacgcagcagggcccgctgctgctccctcaaccttctgacctgggtggggagggaggggaatgtcagcagccacccagcccgagagccagagcacagcaggggctggccagcctagccctagagtctttgcagtgaagcgtcacagactcctcatgaaggatgcatggggacccaaccgcatgccacttggcttggcagtgtcaaagggactggggacctgcgaggatgcggtggccattgtctgtgcccagcctggggagcctgacactcacagcccggctgctgctgccttgggcgtcctgaagatcctctgtatgcttgtggggtgggggcagacacacaggcagcctcctgcccagagggtccaagcgggcatggccatccacatctgcaggtcagaagaggcctgggctggagccgcatactggccatgctgcctcgctgtccctgcctcagagccactgtattcactctgcctggaactgtctttcctggatcccaggagtcctgaaggagccgcctccatcctgagctgcctaccctgcccctcctccactccagttgtctccacagccaggtcaccattgaccaggttgtccagtcccctcctcataggggagtggccctttgtctttcaccactgacccttcccaagctggtaccatgcctaacccatggtgggtacacgataaaaatgcagggctgtgccaccagggttttgtcttgacaaagggactggaggcaggttgtcagagtagggctggccggaggtggcctcctgaatgcccctaggaggccagaggagacttccccaaattcactggtcctggaggccgcctcagaggccttttgctgctcagagaacactgggctggaaggtcgtggtctgtgacgtaggatcggggaggccacctcagaggccttttgctgctcagagaacactgggctgtaaggtcgtggtctgtgacgtaggatcgggcagcacgcacctttccacctggcctggaggtgattctgaagggcttctggggaggcgtcttcaaagctgtgcctgtgtgtgtcaccacgtgtttgccaggtgacctgggactattgtgtggtttcccgtttgtgaagtggggcagcgtgctggaggagcatgcatcacatacccagaggtccccagtgtggtctggggactcatcgttcacactcgtgtgtgtgctttctggaggcatgcgtcatggaacagcctcacctctcacttctgcacttgtgagcctggttctcacagggtcaggctgtagcctcctcctgctcccggctccgcgtcctcagcccaacacaccaagcctggcctttcatgcactcctccattcaaagccgtgtgttctgattgtgcacttttggtggctgccacaggattaaatcctgaatgctttgccagttgagatcaaaagtcaccccaactcctctgaaacctcactgggacctcaaggtgctccagatcctactgcctcctgccgtttcctgggcctttgttgcccagtattttggttttgtcttttaaacaatcctctttttgttgatgctgcatacattgagatatttactcacagacttgcagttttctgtctcaccatttggatttaatttcctttttcctgaagtctgtgtttctttcagtgaaggtaaactctcagtttcagtttgtctgaaatatttttactttgcctttattcttggatgatggtttcgttgggagaaagtaacaggttaatatgtacattttgtctgaagactctggagctgtaacactgcagtctcctggcttctgtgggtcatcaggctaattgattttcctttgtaagtgaccctccctacctctagtgacttcagaaaccttccttttgactttagtgttcagaggtttcaatgtactgtaccaaggtggtgcattatttttatttatcatgcctacactttgttgtgattcctgaatctgagggtttatgtctttcatcaaccgtggaaagtcagtaccattatgttgtagaatattgcctcccctaatgcttctgatcttttccagaaacttctatttgaccatctcattgtcttcctcagctgtctcatagattttctatctctgtctccctctgcttcattcacagaattttctatgcagtttctaactcttgagatgtttctgttccactgctttatctacccactgagactttcagttatatattttttccttccctataaatccttgtatgggggtttaatttgcttgattttagcatcttgtacctttctcatattttaaactacaacttttaatctttaggtcatttgaacatgcatattttgtaccctctatcctgtcatttcatcatctgcagttcttggagagtctaattctgttcactgtagttttttctgactcttgctcatgatggctcatttcattgtgggtttgcaatttagatcatgagtttgtgtggtggatgtttttgtttgtggggttcctatgtatcctgtataaggtacatgcctctggagaagctgcacttttgcttgtacagggtgacccagtgaaccaatccaggaccttcatgatccatgttttagatatgggatcttctagacaacctatgcagtgtaaacagaaaccccaatctcctgtgagagcaagtctaagtaacatatattgagaagagagttttattttataaaataaaactgtctttatttgcagaagacatggttatctatgtagaaaatctgatgaacatgcaagatgaccactatgactaatatatgagtttagtaaggtggcagatacaagattaatatgcaaaaatcaattccattcatatattcttgcagcaaataaccagaaattgagatttttaaaatacaggcgtgtctcattcttattgactgcactttgctgataatgcattttttacaaattgaaggtttgtggcaaccttgctcaagttgaagccagtactcacgtaccatttcaacaatcctagggcccttaagaattatgctaaatctactctgcttatgctctataatgaagcaacaaagcccgatgacagtacatctgttgacaacatggtttactgaatatgttgagcccattttcgagacctattgctcagacaaaaagatccctctcaaaatgttactgctcattgacagtgcacctggtcatccaagacctctgatggagatgtacaagattagtgttgttcttatggctgctaacacaacatccattctgcagcccataatcaaggagtaatgccaactttgaagtcttattatttaagaaatacattttataaggctatagcggccatagatagcgattgctttgatgaatctgggcaaagtaaattgaaaacattttagaaaataatcaccattctagatgaaattaagaacattagtgattcatggaagaacgtcaaaatatcagcattaacaggaattgggaaaaagttgattccaaccctcatggatgactgaggggttgaagatttcagtggaggaagtaactactgatgttgtgaaaactgcaagagaactagaattagaagtggagcctgaagatgtggctgaaatatcattagttattagagaaatgcaaataaaaaacacaatgaaataccacggcccaattattatattatataaaatgagggagatggatgataccaagtgttggtaaagatgtgtcggaggtggaactctcatatgctcccggtgagaatgcaaagtccaaagcgatgcaaccatttgggaaacagttcagcagtttcttgatgtgttaaatacatacctaccatattctacagcgattctattcctaggtatttatccaggagaaataagatcatatgcatgccaccatttgtacatggaatattcatagcagctttataaaaactggaaaccccaaactggaagcaacccaaatacccatcaacatttgaatagatttttttcaaagttgtagtatattcctaaaatggaatactacttagaaatacaaaggaatgaaccactgatatgcctacaatatggatacattgcaacataattatggtgagtgaaagaagccagacaaaaaaaaaaagagtacatggtatcttatttatgtaaaaatctagaaaatgaccactaatatagagtgacaaacaagtcagtggttatcagtggttacctggggatcaggggtagtagtaggagggaaaaggacaaaagggcacaaaaaaacttttggggcagtggatatgttcattatcataatcatggcgatggtttcatcatgtgtcaaaagttaccaaattgcacactttaaacataagcaagttatgtcaattatatctcaataaaactgtttataatatataatgtaaatatataatatatattttgcatagcaaaaaaacatactgaaaataattttttattgataacctaaagaaaccagttgccactcacctataggcatggggctaatttaattgctatataaaaacgctcttgtaaatcaagatagaagttaaaggatattaaaacagttcacagaaaaggaaataccaataattcttaagaatgaaaatatgctggatgacttcaattatgacaagagaaatgcaaactaaagcaatggggtttttgaaacttatctgattattaaatatcaaagagtttgataacactctatgggtatgtgtacatggaaactctcagtctcagtcattgatgttagaaaaataaattgatacaaacctctgtggagataaataaggcaatttcaatcaaaattaaagatgcatatgcctttgaatcattctagaaatttattctacacatatcttacacatttgcaaaataatccatcatcaggatattgatttctgcaattgttaaatagcaaaaaattgcaaaccaccgacatacccatcagtggaggtctgcttcaagtatcatatctccgttaaacagccatcaaaactgtgaagcttcactctcatcactgatgcaggacatccctgatatctgatcctagaaataacagtacatctttcagaagagtatgaaatctgccatcatgtgggggcaaatacaatggtttacaaaacaaagttttatctaccttccttgttctgtgtcttggaactgtttgaagaacattgggattatcttttctgtagaggttaaatagaattgagttgtaaaaccatctgggcctgatacatgttttataggatatctttagtaatttctttttagtctgttttatgatatgttgttctaaattagtttattgcatcttctggagtatttatcattgctatttaatttcctcaagcatttcaattgtgttgccacttggtagcaactgattttttcctttagtgattttatggtcttctctatcatctcttcgtttttcttttcctttatgcctgaacttttgtggtttttctccttttttcttaatcaagcacatgagaaatttatgttttatttatattttattatcagaaaactatctttgtactctttgttatctatttcattaatctaagcttttatagctattaattcccttttcttggctaactctatttttgttttcttttacttaagagtcatagttcatttatttgaagttcttctactaaaggcatttttaaaggctataaattttcctctgattgcagctttagctgtgacacgtagatctgattatgaaatatgttccttttcattgctttcttgatagttttaattttgtgttttgatttttctctttagagttcttttaatgtcttcttaatttttaagcagtaaatttttatcactgttatttatttctaatttagtaggcttacagtgaaaggatgtagcctatgaagtctccactttttttaaaatgaagattttctttgtctccaagtatgaaaataacatcattatttttgtaaatgctccacagacctcagaaaatatcttctgtatttgtataacacaaagttttatttgtatacatggacagacaaaatgtacattgagatggattgtgtatacatacttattcattgcctcatttaggtctgctctgcccttagttaaaaaaaaaaaaccctaatacatctgccaaattctgagacaggaaaattaaatcttcctgtacaattatgtttctaaaaattgagtggcaggtttcatggagtggtttggagcacagcctatatggccaaccttctttagggtcatagcccagctctgccattttcttatgtggccctaagcaagctactgcattctctgtgcctcagtttccacatctgtgaaatcaggatcctaactgcctgctcccaggactcctgtgttgactgagtgagttagaacatgtaagtgctcacccaggacccatatgcagcaaacagtcttgtgtctctgtctgctgccaaattggcctcaggctctatcaataccagatctgaataggggctattctttcttttagtgtccttaatgttgtattactttccaatattcacactttaactttacagatgagtagaatggaatagatgtgtttcagtacagaacttttttcttatgtttgcttgggctcccctcctctctgttacctatgttgataatctaggatttgttgtcttacatttttcctgatgttcatataatattcaatgaaataaaatacatgtgacataatgaaggcattatcattgttttccaaactcacgggatcatatcatacctgctttctgcatcttgtttttctcaatcagtaaaatagtaaaaatgcctctaaggctgctgaaacaattttattttgatttaattctatctctaattgaattttatttctatttcaattctattctaaaatttataatctctgcttaatttcctttggtgtacatactctgtgatgttctctatcgcttaaaattcattttgttcaagaacataggttcttgaacctgtttctatgtacagaacttttatttctatgtgttaactttccaggatgtattagtttgctaggactgccataacaaaataccacaggctgggtggcttagacagcagacatgtatttctcacaattctggaggatagaagtctgagatcaaggtgtcagcaaggctgctttccctgaggcctctttccttgccttgcagatggccgccttcttcctgtgtcatcacatgaccattgctctgggcacttgcaccctggtgtttctctgtgtgtccaaatatccttttctttaagggcaccagtcacactggattagggcccaccctaacagcctcattgtagcttcatcacctctttaaaggtcctgtctccaaacatgctgagtcacgtgccgaggtattaaagaccagggcttcaactgcaaaccttgtgggacacaattcagcccgtgacacaggaataggcttgttaatttcagtgatgtagccaggttgtttttctcgttttgtctgaccttgaattccacaggcagggttcctctttcccggccggcattcctgcccaccagtcctggcagagtgacttattgtcagccaagtggggcagagtttctccactgtacctctattgaaatctagtgccggataattctttgttgagggaggaagtcctgtctattgcaggatgtttagcagcatctccggcctcagttatgaccaccaaaaacatctccacatgttgctacatgtcccctggagggcaaaattgcccccagttgtgacctgctgagctaaagcagtccctcaggattgtttcttaaaacaaaacaaactgtttatttggccataattttgaactacagaaaaattacaagcacgagatataaaaacacctacatacccttcactaagatttaccagtttactaattgttacattttgccacatttgctttatcatttgaacccctttctctacattatattcacataacatgtttttctgaaacatctgtgagttgcatactccacagctctttgcccctaaacattttgctgtgtatttctgaaaaataaagatattatctttgaaagcagttatacagttattgacttcggcaattaaaattcaatattatacttggacctaatttaatgcgtatggttcccattttgtcagttgccatgacaatgtcctttgtggcatattttcctccactgcaagatccagttcagggtcagtactgcctttagatgtgtctcttcagtcttgtttaatctggaacatttctagtctctttctctgttatgacactgatattttttaaagatacagtcctgccacttcttgggggagtctgatgtttcctcaggttagatccacgttgtgtactctgtaagtgacctgatgtccttctcagtgtatcacatcctgaggcacacagtgtatctgccccttattaacgatgttattttgatcaccaaattgaggccgttatccacttttctaccttacagttactatattttgccttgcaaccaataaacaatcgggggagattctttaaggccatgcatataccctgctacttgttaaaaaaaaaaaaaaagtctctccagatttaaatgcttttggaaaccaggctttactgtggtagttgcaaaaatgatcattttccaactctagcaccccttccacgaaagtacagaaagaaaaaaaaatactgtccagttggaatggttacctcattgtggttttgatttgcattttcctaatgatgctgagcatttttccacgtgcctagtgcccaattgtgtatcttctttagtgaaatatttattcagatcttttgcccgtttaaaaaaatgagactttcaagctttttatttttagacattcatatgcagtggtaagaaataatagggatcccatgcacctttagttagtttccgtcagtggtagcatcttctaaaaccatagcacaatatgataaccaggatgtcaacagcaagagtccagatgcagagtgctcccgtcgccacggggttcccattatttgtccttttacacggactttctcccatcccatccctccaatccctggtgaccactcatctgttctctgattctctagttttgtcttttcaaaaatgccacgtaaatggaatcacacaatacacgatatcttagaaacggggtcttttggctcggcatcattctctggattcattccggttgttttgtatcgcgacagttcattaaatcatagtgctgagtggagtttcacggtatggacatataccccagtttatttaaccattccctcatccaaggacatgtgggtcattcccagtttgggctattacaaatcagagtaggctgaacaatggcccccaaagtagccaggtcctaacgcctagaacctgtgactatcgccttctatggcaaagggcactctgcagatgtgtcaaattaaggaccttgagatggagagatcatcctgggttatctgaatgggcccggtgtaatcacaagggtccttataacagggaggcagaagaatgactacagaagagaaaaagggttacgtggccacggaagcaggggcaggaaatggcaatgtgatttgaggaaggggtcacaaaccaaagaacgcttccagaagaaaaggcaaggaaagggaagggatgctcccctgaagcctccagaaggaaccagccctgctgacacattgatttttcgtcccctaagactcttttcagacttctggcctctagaactgtgagaaaaaaaaaaaaagcgtgtcttgttttaagccactaagtttgtggaaatgtattacagcagccatgggaaccttatacattgataaggatgacatgaatattcttgtaaggttcttgtgtgaacataagtttttatttctttgggataaaagcccaagcttgtaattgctgagttgtgtggcagttgcatgtttagttttataagaaactaccaaactgattttccagagtgactgcaccatttcacattccccattcctgccagcaaggtctaagtgatctagtttctctgcattcttgctggcatttgatgttcacactgtttttaattttctccattcagataggtgtgtagtgagatctcattgtggtttacatttacatttcctcattaggatgatactgaacatcttttcatgtgcctgtttgccatttttgtattctatgcagtgaaattcttgttgatatcatttttccatttcccaattagactttttgttaactgtcgagttttgggagatgtttatatattctagatacttatcttaagtcagaaacagggtgcaaatatttattcattgtagctttcattgtcatcatctcaacagggtactttacagagcaaacattttaaattttgatgagattcaatgtttcctttttatggattacacttctgatgtcaggtctaagaagtctttggccctggaccccaaatatcttctgctatagcttttttctaacagccttgtggagatatagtttacataccatacaattcacccatttaaagaatataattgaatggtttttagtataggcatacctcagagatattgtggttcggttccagtacactgcaatgaagcaaatattgcaataaagcaagtcacacaaattttttggtttgccactgcatataaaagttatgtttatattgtagtctattaagtgtgcaatagccccatgtctaagaaaacaatgtgcctaccttaattgaaagacactttattgctaaaaaatgctgacccagaatgaagtgagcacatgttgttggaaaaatggcactgatagacttgctcagtgcaggcttaccacacacatttaattttttaaaaacacaatatccacaaagtgcaaaaaagtgaagtgtgcctgtgtatccccagagctgtgcaactgccactccagtttgagaacatttttatcattccaaaaagaaacccagtgccttttaaatatcacccccaaacccactattccatccccctcagccctaggcaataactaatctttctctctatgggtttgcctattctggacattttatataagtggaatcatacaatgtatggtcctttgtgactggttactttcacttagcatcatgttttcaaggtttgtgcttcagtgcttctttttttttccccgagacagagtctccctctgtcgcccaggctggagtgcagtggcgcgatgtcggctcactgcaacctccgcctcccgggttcaagcaattcacccgcctcagcctcccaagtaggtgggattacgggcacgcaccaccaagcccggctaatttttgtatttttagtagtgacggggtttcgccatgttagccaggctggtctcgaactcctgacctcaggtgatccgcccacctcggcctcctaacctgctgggaccacaggcgtgagccactgcacccggcccttgtgcttcattcttttatgaatgaataatcttccatcgtatgatatacaatgaataaacattttgtttatccatttatttgttgataagcattttagattgtttccacattttgactactatgaataatgcttctagaacatgtgggtttttgtgtggacatgtgttttcatatctcctgggcatgaaagagatatgaaaggctgggtgtgttggtggctcacacctgtaatcccaacagtttgggaggccaaggcaggtggatcacctgaggtcaggagttcgagaccagcctggccaacatggtgaaaccccatctctactaaaaatacaaaaattagctgggcatggtggcaggtgcctgtaattccagctactcgggaggctgaggcaagagaattgcttgaacccgggaggaagaggttgcagtgagccgagactgtgccactgcactccagcttaggcaacagagcaagactgtttcaaaaaaacaaaaagaaaggaagaaaagaaagagatatgaaaacacatgggagtggaaagctgagtcaaatgatcactatcttttttttgagatgaagtcttgctctgtcgccaggctggagtgcagtggcgcgatctgagctcactgcaacctctacctcccaggttcaagcgattcctctgcctcagcctcccaagtagctgggattacaggcacatgccaccatgcccagctaattttttgtattttagtagagacagggttttaccatgttggccgagatggtctcgatctcctgacctcgtgatccacccgccttggcctcccaaagtgctgggattacaggtgtgagccacagcacctggccgataactatctttttgaagaactgaccaattatttccaaagtgggtgcctcattttacattctcaccaccagcatatgagcactgcgcaagttctccatatcctcaccaacacttgctattatcttttttcaattatagccatcttagtggttgttaagcagtatctccttttgggtgtgatttgcatttccctgtgactactcacgttgagcatcttttcatgtgtttattaactatatgtcaaccctgaagaaatttctattccgatttttcatccattctttaagttgggatatttgtctttttgtttttgagttgaaggagttatttatatatccagtaacaagtcccctatcagatagattatttgcaaatattttctcccatctgtaggttgtcttttcactttctttaaggtgtcttttgaagcacaaaagcttttaatttttatgaagtccaatatatctactttttttcttttgttccttgttctttggtgttatatctaagaaacctctgccaaatccaaggtcataaagatttacccttatgtttaccctaagaattttatagctttatctgttacgtatttatgtctttgatccactttgagttaatttttatatatgatgtggagtggaccaattgatttttctcatgtggatatcagttgtttcaacactatttgttcaaaagactattctttccgcattgaacattcttggcatccttgtcaaaaatcaattgaccatagatatatggctccgtttttacactctgattctattcccttgatctacatatctatctcatgccagtatcacattttctcgaatactgttactttgtagtcaatttggagatcaggaagtatgaagcctccaacttttctttttcaaaattgttgctattctgggtcctttgcattttcatatgaagttgaacatcagcttattattctacaaagaaaccagctgagattctggtaaggattgtgttgagtttgtagatcagcacgattccgggagtgttgccatcttaacaatattaagtcttccagtctatgagcatgtaatgtctgtccatttatttgtatcttcttttctttcaacaatgttttgtaattttcagaggataagttttgtacttgttaaacttattcccaaggtattttattttttctttattatggtaaaaatatacataaaatctactattttactcattttaagtatatagttatgtggcattaggtaaattcgcactgttgtgctttattcttttttgatgttatacatggaattgttttcttaattatattttcagattgttttttgacagtgtgtagaaatacaattgatttttatatactgattttgtctcctgcagccttactgaactcattcgttgtaattgtttcacaatggattccttggggttttctgtatacaacattgatacggtttggatgtttggtccctccaaatctcattaaaatgattcccaatgttggaggtggggtctggtggggggtgtctggatcatggacggagccctcgtgaatggcttggtaccatccccgtggtaatgagcgaattcttactctggtagtttatgctaagagctggttgtttaaagaatctgctacctccctccaccttgctcctgctcttgccatgtgatatgcctgcccctctgcctttcgccatgattgtaagcttcttgaggccctcaccaggagcaggtgctggtgccatatttcctgtatagcctgaagaactgtgagccaattaaaatcttctttataaattacccagcctcgggtgttcctttatagtaacacaaaactggaccagcacaaatttatgtcatctccaaatagttctacttctttctttcagtctggattctttttcttcccaaattatcctggatggaacactcaataaatgttgaatagaagtggaaagagcagatctctttgtctcattcctgatcttaacggggaaacattcagtcattcactgttaagtatgatattatctgtgattttttttttttttttttttttttttttgagacagagtctcgctctgtcacccaggctggaatgcagtggtgtgatcacggctcactgcaagctccacctcccaggttcacgccattcttctgcctcagcctcccgagtagctgggactacaggcgcatgctgccatgcctggctaatttttttgtatttttagtaaagacggggtttcaccatattagccagtatggtctcgatctcctgacctcgtgatccacccgcctcggcctcccaaagtgctgggattacaggtgtgaaccactgcacccggccaactgtgatttttaatagatgccctttatcaggttgaggatgttcctttctattcctagtatattgagtagggctttttctcccatcatggaagggtgttgaattttatcacccaaatgcttttctgtgtcttttattctatcattaattgctatagactgaatgtgtgtgtttcctcaaaatgtatatgttgaaatcctaacccccaatgttggtattaggaggtgaggcctttgggaagtggttaggtcatgagggtggagacctcatggaatggattagtgcccttgtaaaagagacctcagtgagctcctttttttcttccgtcatatgaggacacaagaagacaactgttcatgaaccagaaagcgagtcctctccagatgctgaatctgccagtgccttgaccttggacttccaagcctgtaaaattgcaaaaaataaatttctgtgtttataagccaccagttcgtgatactttgttataacagtctgaacagactgacagaaatcgtggtgttttgtcttttattctgttgataatggtgtattacattaattgattttcagatgttaattcaaccttgcattcctgaaataagtcccatttggttataatgtataatcctttttaaacattgcttgattttacttgctagtattttgttgagggttttgagggttttacatcattttcatcacagttattgtaatgaaatacaaaaatcaatagtattcctatacactgtcaaaaacaatctgaaaataagaaaacaattctatttacaacatcaagaaagcataaagcacaatagcgtggatttacctaatgccacagaactatatacctaaaatgggtaaaataaattttataagttctcttttcatgtttttgtctggttttggtgtcagggtgatactggactgaaagaatgtattggaaaaattttccttctcttctatttttttgttgttggaagaggtcataaagaattgatattctttagatatttgttagattcactcatctggccctcttgggcttttcttttcaactagtgttctcataactaattcaatctctttaacttattacagatccattcacattttctacttatttcttagtcagttttcatagttttcatctttctaggaatttgtcaatttcatctaagttttataatttattggcacaaaattgttcatagtgttccttcataatcctttttatttctgtcaggttggtagtatacttccctcattcattcctttttccttttctttttgagaaacagagtctctctctgttgcccaggctggaatagagtggtgtaatcatagctcactgtaacctcgatctcctagtctcaagtgatccttgccccttagcctatgacaggtgtgcaccacaacaccagctgttattcaaaaaatattttgtagagatagggtcttgctttgttgtgcatgctattcttgaactcctggccacaagcaattctcgaactcctggccacaagcaattctcctgccttggcctcccaaagtgctgggattacaggtgtgagccactgcagctagcctcgtttttttgctttaatttgtaaaactgtcattcatttctgattttagtaatttgagttttctctctccccctttgcctcatgcacttccctctctgtctttcctcctccccctctttcttcctccccttcttttcttctccctctccctctctcttaccaatctatcaaaggtttgttaatttcaaagaaccaaattttggatttgttgactttattatttttatattctatattttatttctactctaatatttattattttgttttttctacttgctttaggtttagtttgctcttctttttctagtttcttgaggtggagagttggcttactgatttgaagccttattttttgatataggcattcatagctataaaattccatctttacactgctttaaatgtatcccataagttctgttatgttgtatcttcattttcattaatctcaaagtacgttccatttcccttgtgaattctttcacccattgattatttaagaatgtagtgttgtttaatttccacatgtgtatgtttccctaatttctttgctactgagttctacttttatttcattatattcagaaaaagataccttgtattatttcaatccttttaaatttatgcaggtttgtttcgtgacttagcatatggtccttcttggagaatgtctcatgtgcacttgaaaatactgtatattcaatgttggttgttgggcgaagtgctctataattaccttttgagtctagttggtttatggtgttgctcatatcttctgtttccttattgatcttctttcttgtactacacattattgaaagtggagtgttgaagtctccaactactattgttgaattggctatttctctgttcagttctgtcagtttttgcttcttatgttttagttctctattgttaggtgaatatatgtttataatcattgtatcttctcatgaattgacattttatcattatgagatattcatatttaacttcagtaacattcttaatttaaaatctcctttgactttattatagcacttcaggttacttatggttgctgcttacatgatatatctttttccatccttttactttcagttggcatttatcatctaaagtgtgcctcatatagatggaatacagatggatcctgtttttcaaatctggtctgataattcctgcctttgattagattgtttaatccattcacatttaatattattattgatataattagatttatatccacagttttacttttggtcttttctatgtactatttcttgttcctctatttctcctttgctgctttcttttccatctagtgactactttctaatataaattttcatttcttttatgattcttcaatattctatttgttattagtgtttgctctagggcttaccttatgtatcgtctcaaaatttacttcatatttatattaatcctggtgagatacagaagttattcctgtatgagtttattcagttttaccactttttgtggtattgttacatatattacatctttattatgcgctattataatgatcatactatataatgatatatctttaaagaagctgaaaggagagcaagtatatatttctagtttctgttttattaacctccttatatcatatatttgatccacttttttggtttttatggatttgagttaccaactggtggtatttccttactctagaacagctttgctcctatttacctccttgctctttgcttttggatatatgtgaacttcctgggagcacttcctttttgcctgaagaacttcctctagtagttcttacaaaactggtctgctaacaaggaattctgtttttgtttatctgggaatgcttttattttgccttctttttgaaagaaacttttctggacacagtattcttggttggctttttttttttttttttttttttttttttactttgagcacttgggatctgttaccccactactttctgggtaccactgtttctgacgaaaagtcagctccacatttgtctccctgacaccagaacaggggagggtattaagcagagtgccacatagcctcacctcccaccatttcatccaagaatagtagttgggtaatagttcaataactcactctgaataattgatagaacaacaagacagaaaatcaacaagagttagtactattattgttgagttgtctattattgttcagttgtctgtttctctcttcatttctgacagttttatttcatatacttcagggctgtgtttttagctgttataaatttttatttctttatgacttctgtttatgatttctatttcttcctgttaaattttcccttttgtcattgtaaaatgcttctcagtatctctaataacatggtttgtttttaaagtctattttgtctgattttatttatttttattttatttttgggatggagtctcactctgttgcccaggctggagtgcagtggcgtgaccttggctcactgcaacctctgcctcccggattcaagccgttctcttgcctcagcatcccaagtagctgggactacaggcatttgccaccatacccagctaatttttagtagagacagagtttcaccatgttgaccaggctggtcttgaactcctgacctcgagtgatctgtctgcctcagcctcccaaaatgctgggattacaggtgtgagccactgcacccagccaattttgtctgattttagtacagtcactctagctttcttattactgtttgcatgtcatctttttccatcattttactttcaactatgtctttgaatctagaatgtgactcttatagaccatatatatttggatcctgcttttaaggcagtctggcaatctctgctctttattgagtttttaattcacttatatgtaatataattattgatatggaaggatttatatctaccatgttgttatttattttctatatgtctcatatcacttttgttcctctcttcctcctttactgccttctgcaggttgaatagatatgttctagagtaccattctaattcctttgttagtttatttcccccatttttaaagtgtaatctggaggttacaataagcagcttaagcaaaaacaatctgcttcaggttaataatctactcaaatatttttgtctgccctattctctccttctcagtactcttattaacacatatgttgttactccttaattccacatatgttttctactcttaattacatatatgttacaacttaattacacatacattgttacacatcctgttaggacaggggttcccaaccccagggccatggactggtaccagtctgtggcctattagaaactgggctacacagcaggaggtgagcagcaggcaagcaagcattactgcctgagctctgcctcctgtctgatcagtgatggcattagattctcacagagagcaaatcctattgtgaactgagcatgtgagggatctaggttgtgcactccgtatgagaatctaactaaagcctcccccaactggctgtggaaaaattgtcttccacaaaactggtccctcatgccaaaaaggttggggaccactatattatggtatccaatgggtatctcttcatttttcttcattatttttctttctattcttcagtctgaatcatctttatggatctgcgttgaagttcattgattctttcttctgccaggtcaaatttgcttagccgcactagtgagtttttcacctaagttattatatttcacaactacagaatttctatttggtttctaatttctatctctatattgatattatctatttgatgagtctttgtcatcacacttgcattctttaatgtggtttcttttggttctttgaacatagttataatacttactttgaaatcgcgccctaacatttggggcccttcagagataattcctatttattgctcattattcttgttcaagggtcacaattttctgtttctttgcatatctcattttttttgttaaaaacttactttagataatatatcgtagaaactctggattctagttcttctccctaaccagggatgatttctgttactcatttatttgtttgctcgcttgtgtatgccttctctgcatggattctgcagagtctgtgttctcctgcagtgtgcagccactggtgtctttgctcagttttgtttgttttaattcttatgtttgttttgtaagcctggcttcattggtgtcacccctggatcagcataacctagtggtcaagccatgattagtcagacatttgtttaaacatcttgagccagtgaatcttccaccctctgctgaggggatctatgtgtgggttgggacattcaaagttcaggcactttataactctgtcctgtattttactgtctgcttgcaaaaggtctcacagtcagccaaggataagtagatagcaggaaacctctctgatctctcctgcaagcatgtacaacttccatatctccagaattccttttaaaatttttcttaatctgtcgcttgcccaaccagtattgaaacattaggttgctgtgatgtgggttgcctccaattatttgccactgaaatccttgttgcttaacatagtgcatagggttttctatggaattcaaaatcagatgagccttctttgttgctggtcctcaagcctaccgtgcccctgagcttgggtggggagatggcagccccacgttaaatcataaccctgctattcttaggaaggcttaatattttttctttaattagcacttttcaattttatatttctttgtccagttttatcattgcttttcagggagtggttatatcaaggtgctcattccaccacctcagaagtggtccctatcttgttaattttattttttgaatacatataacattaacatacttccaaaagtcaatactaaacaaaaggagctactgagagaaatcttcctctcacccatatctcttccatcctaattccccctacccattataggtaaccagtttcagtgttttctagtttatagtttgtgtgtgtttgctctttataagacatgattattttctcatttcccaaaaaagtactattctgtatatgcccttttgaactttgcttttctcacctaacaacatctcctagaaatcactcaacatccattcacagagatctttctcattgcattgctaaagttgcatagtattccttagtgtgactgtgctataacctttcaaccaatctcttatgcttgcatgtgtaggtggtttctagatggcagctatgctcaccattctttggctttcctaccatgtctctgagatacatctactccataaatcgaatctacccccaagaggtgattctctgagggtgccacctcaaatcttagtcatttgcaagagcctccactatagctgctgctctggactacctatttctgacatgtgttctccatgttgacatttaatatagagtcttctttttctggtgataattctgtctgtgctgctttttagtcttctgtgcaccctttaaattttttaagtaacagaaaccatttcaaaatgtacaattcagtgtcacttagtacatttacaatattgtgttttttgtgtcttttctaagaatttatttccaatctcaagtcataaagatttactcctgttttctactaagaaatttatgcctttaactcttattttttggtctctgatacattttgagataatttttatatgctatgagttatgggtccaacttcattctttgatatatgaggatccagttgccccagcaccatttgttaaaagactactcttcccactgaattcttgatacatttgttgaaaatgaattgatcatatatgtgagtgtttatttctacattctctattatattccattggtctatatgtccatccttgtgtcctagagaccacattgtgtcagtaccacattgttttgattactgcagctttgtaaaagttttgaaaatggcaggcctgagtcttccaactttgttctttttcaatatgattttagattgtttggggccctgggaaaattccatttacattttaaaatcagtttttacatttctgcaaataaaaaggcccttgggattttgataagggttgcattgaatctgtagatcactgggtaatatcgccaacttaacaatatttaatcttccaatctgtgaacacaggatgtatagttctatttatttaagtcttctttaatttttgtcaacagtgttttgtagtctttagtgcagaagtctttcaccttcttgttttaatttattcctagctattttactctttttgatgctattgtaagtggaattttaaaaattgacttccttcttgggctgttcattcctggtatatagaggcacaaatgattttcttaaaataaatgttgaacatgtaccctgcaattttgctggacttgtttattagctctactagtttgtggattctttgattttctagatagaagatgtcattattgaataaagagttttactgcttcctttccaatttggatgctattcatttacctgtttgtttatttatctgcctaattgtcatggttaaaactttcagtacattgttcaatagcactgggtaaagcatacagccatatcttactctttgttatgggagaaatttttcagttttttttctcattaagtatattagttgtggatttttcacaaatcctctttaacacattttgaaagttccatgtttttatcctgaaaggttgtagaattttgtcaaatgcttgttctgagtgaattgaaatgattgcatggattttttatccttcattgtattaatgtggtgtattacattgattgatactcttgtactgaaccacccttgtattcttgagataaattccatgtggtcatgatatataatcctttttaatatgctgctgaatttggcttactagtactttgttaaataaaagattttagtatctagtttgtcttttcttgtggtatatttgtctggctttggaatccatgtaatactggcctcatagaatgtattgcaaagttttttctcctctgttttttggaagagtttgagagggattggtgtgaattcttcaagtgtttggtataattcaacagtgacgccatctgtgtagcattttcttcattggaaggtttttggttactgattcaaactttctacttgttatgggtctgctcataatttcaatttctgttttggtctgtattagtattttgtgaattcgtccatcttatctaggttatataatttgttggtatacagttattcatagtattcttttatcacactttttatttctgtaagatcagttatatcgttcccacttttgtttttttttcttatttttgtttttttttgttgtgttcctacttttgtttatgattttagatatgtgcaacttctctaattttttattagtcattctagttaaaggttttcaactttgatcttttcaaaaacaagcaacttttggttttgttaaattatctctgttgtttatttaagctcgaattcagttttatctccactcatacatattatttcattctctcttttaactttaggtttacttcgttcttctttctctggttacgtaaggtataatattaggttatggatccttcttctttttcagtgtgggcattcacagctataatttttcctctgagcacttctttcactacatcccataagtctgagtatgttgtgtcgtcattttcactttttgaaagtattttataatttcccttctgatgtcttctttgacacaataatttttaaagagtgtgtagttttatttccctgaatttgttaatttttaggtttttcttctgttacagatttctggcctcactatattgtagttagagaagatattttgtatgatttctatattttaaaatttattgagactcttttgtggcctaacatatcatccctcctagggaatgttccatgtgcacttgagaagaatgtgtagttgggtggagtgtccatatatgtttgtaggtctagttggtttatggtattgttcaagtcctctcttttcttattgggcttctgtctggctgtacattatcttgttgtgttttttttttttaattttaaaaatatgcatatttagtgtataaaacatacagttaaatcgttaacatagtgatgcaaattaatatgtccatcatctcacagttattcttttgtgtgtatgagtgagaaaagctatgatctactcaattggcaaaaattccaaatgcaatatactaactattctcatgttctacatgagatctctagacttgttcatcctatatatctgctacttggtatcctttgacctacatctttccattttcttcccccacaccttgcccatggtaaccactagtttattctatctctgtatatttgacttttttctttttaagattctacatataggtgagattatttaaaacttttcatttgtatatggcttatttaacttagcacaatgtcttccagtttcatccatgtggcaagtggcaggatctccttttttaatgcggaataatattccattgtagacatacacaccacagtttagtcatccatcaatggacacgtaagttttcatatcgtgactcatgcatataatgccacaatgaatataggagcgcagatatctttatgaggtggagatttcattttctttgggaatatacctagaagagggattagtgggtcagatgatagtatattttcaatttctttaggagccaccattctgtttttcattatgactgcaccaatctacagtcccaccaacactgtacaagagttccctaaccctagccaacacttaatagctattctcatgagtgtgaggtgatatcgcatagtaattttgatttgcatttccctgacgattagtgatgttaaatgtcttttcatatatgtgtttgccatttttataacttctttgcaaaaatgtctactcagttccactgcccattttttaattgggttatctattttcttgttattgagttgtatgcattccttataaattttggatattatcctcttataagatatatggttggcaaatattttcttctagtccataggttgccttttccttttgttgactgtttccgttcctgtgcagaagttttttagtttgatggtataccaattatttgtttttgtagcctgagcttttggtgtgatctccaaaaaatcactgccagagccatgtcgagcttttcccctatgttttcttctggttgtgggttttggtcttatgtttaggtcttttatccattttgagtttatttctatgtatggtgtaaggcagcgatatcaaatcttttggcttcccggggccacactgtaagaacaattgtcttaggccacacataaaatacactaacaataacaacagctgatgggctaaaaaaatgcaaaaaaattcaatgttttaacaaagtttacaaatttgtgttgggcctcattaaagccatcctgggcttacatgtggtctgtgggccatgggttggacaagccacagaactgggtttcctaacgtcatttatgagagagactatctttctgcattgttttcttcgtgttcttgtggaaaattggttgatcatatatctttgaatttctttctgggctctctattctgttccactggtctacatgtttgttttttatgccaggaccatactgtttgatcaatagttttgtaaaataaaccagaaagtatgaagtctccctttgtttttcagaacagaattttcagaatttcgttggctacttaaggttcttgctattccaaatgaactttagaatttaaaaaaattttccatgggattttgatagggattttattcaatctgtatattgatttggatattattgacattttaacaatattattcagattcatgagcatgggatatctttccatttatttgtatcttgtttaatttctttcatcaatgattcatagttttcagtgtacaggtctttcatctttttggctaaatttattcctaagcaatttttttgatgctatcataaatgggattgttttcttgatttcttttttggccaggtcattatttgtgtatagaaatgcaactactgttttatattgattttatatcctacaactttactgaactcatttattagttctaacaggttgctttgtcagagtcttcggggttttctatatgtaggatcatgtcatcttcatataaagataatattacttcttacttcctgatttgaatgtctttcatttctttttcttgtctgtttggttgtactagtacttccagtactatgttgagtagtagtagctagagtgggcatccttgccttgtactggttcatagtagaagggcttctgttttccctcattgattataacgttagctgtgggcttttcataaatggcattcgttatattgaggagtgttccttctatacctgaactgttagaatttatcaacaaaggatgttcaacttcatcaaatactttttgtgtgtcaattgagatgatcatgtggttttcatctttcagtctgttagtatcacattgattgctacatgtatattaaataagatttgcatgccagaaattaattccacatagacatgatatataatctttttgatgtattgttaaatttagtctgccaatattttattaaggatttttgcatcggtattcttgggttatgttggcctgtagtttccttttcttgtgatgcctttggctcacctgggtatcaaggtgatgctggcctcataaaatgtgttaggaagtattccctttagctgcatttttttttttttggaagtattccctatagctgcatttttttggaagagtttaagaagtattggtattctttgaatattgggtagtattcagtcatgaagctatctggtcctgggcttttctttgtttgaggttttggggtttttttaacttttatttttgatttagagggtatatgtacaggtctatatgttgcatggtatatggagtatactgcatgatgatgaggtttggagtgtggataagcctatcacccaggtagtgagcatagtacccaataggtaggttttcagcccacctctccattcctcccccaagtagtccccagtgtctactgatcatctttatgtccatgtttactcagtgtttaggtcccacttgcaagtggtaacatgcagtatttggttttctgttcctgcattaatttgcttaagatagtggcctctagctgcatccatgttgctgcaaaggacgtaagttcattcatgtatatatatatattttttttttttattttttttttagacggagtttcgctcttgttgcccaggctggagggcaatggcatgatctcggctcactgcagcctccgcctaccgggttcaagtgattctcctgcctcagcctcctgagtagctgggattagaggcatgcgccaccacgtccagctaattttgtagttttagtagagacagggtttttccatgttggtcaggctggtctcgaactcctgacctcaggtgatccacccgccttggcctcccaaagtgctgggattacaggtgagagctaccgcacctggccgaattcattcatttttatggctgcatagtattccatggtgtacatgtaccacattttctttatccaatccaccactgatgggcatctaagtggattccatgtctttgctgttgtgaatagtgctgtgatgaacatacaaatgcatgtgtctttttgatagaacaatttattttcctttgaatatatatccagtaatgggattgctgggtcagatggtagttctgttttcagttatttgagaaaactccaaactgcttagcacagtggctgaactaatttgtattcctgccaacagtgtataagcgttcccttttctctgcagccttcccagcaacttttatttttttgactttttaataattgccattctgactggtgtgagatggcatcccattatggtttggtgtttttttgttgttgttgttttgttttgtttttttttgtctgttttttgcttttttgtttgtttgtttgttttttgagaaagagtcttgctctgtctcccaggctggagtgcagtggcgcaatctcggctcactgcaacctccacctcctgggttcaagcaattctcctgtctcagactcctgagtagctgggattacaggtgaccgccaccatacctggctaatttttgtgtttttagtagagacggggtttcaccatgttggccaggatggtctcgaatacctgaccccagatgatccacgcacctcagcctcccaaagtgctaggactacaggcatgagccaccgtgcctggcctcattatttgcatttctgattattagtgatcatgagaatgtttttttgtttggctacttctgtattttcttttaagaaatgtatgttcctgtcctttgccaattcaattggattattcgttttttgcttgttgattggtttaagttccttatggattctggacataggacctttgccagatgaatagtttgcaaatattttttctcccattctatatgttgtctgtttactctgttgataatttcttttgctatgcagaagctctttagtttaccactgtgatctctttgctattggtctgttcaggctttctattcctgatttaatcttagcaggttggtttttttctaggaatttgtccatttcctctaggttatccaatttgttgggatataattgttcataaaagtcccttatgatcctttttatttctgaagtacctgttgtaatatattctccattttcatttctgattttgtcctctttcttagtccaagagtttgttgattttatttttcaaaaatcaattctttgtttcaaaaattgaagtcttagttttactgacttttttcccctatggtttttctttctaacttgtctctgttctgatctttattatttccttctgttaactttggctttagtttgttcttctttttctaattccttgaggtacaattttgggctatttgaaatatctcttcttttttaatgtaggcaaggcatttattgctgtaaacttccctcttagaactgcttttgctgcatgttttgcttttggtatgttgtgttcccactgtcatttgtctgaagatatttttaagtttctgttttcatttcttctttgactctacccattactgaaagtacgttattgaagtccctaagtattattgtagaactgtctttctcactccaattctgtcagtatattttcttatattctggggctctatattttggtgtgtatacgtttccaattgcgaagtcttgagtaattttccattttctcagtatgtaatgtcctcctttgtctcctataacaatttttaaattcaagtttatttcttttattagtataattacctccagctttctttaggttactatttgtatgaaatatcatttttcattctttcactttcaatctacttgtgtctttagaccaaaagtgagtttgttatatacagcataggttgatggttttcttttaaatccattctgccaacctctgctttttggagaatttaatcgacttacatttaaagtacttacttataaaaaagaagttctgacattttgtgccttttcttttgccttacattttttaaatacaacatttcctcccttactgcctttttttgtgtttgatgattttctgatagtgtaccattatgattctctattcgattgtctgtatgtgtgtatgtgtattttaaagactttatatttttagagcagttttagggttccagcaaaattgagaggtaagtacagagatttcccgtatacccactgcacccatacatacagagcttttcccattaccaactctcccaccagagtggcacgtttgttacaacttatgaatctgcatttacacattattatcaaagtccctagttaacattagggctcactgttggggtgtacattctgtgggtttctacaaatgtgtaacatgttgatatggtttggctctgtgttcccacccaaatctcatcttgaactgtaatccccatgtgtcaggggaggggcctggtggggggcaaacttcccccttgctgttctcatgatagtgagttctcatgagatctggttgtttaaacgtgtgtggcacttcccatctcactttctttccctctcctgttctgccatggtaaagatgtgcctgcttctcctttgccttccgccatgattttaagtttctgaggcctgccagccatgcttactgtacagcctacaaaactgtgagtcaattaaacctcttttctcacaaattacccagtctcaggtagttctttatagcactgtgagaacggactaatatgcatgtatctaccattatagtatcatacagatacgtatatttacatatatttgtacattttcactgccctaaaagtactctgtgcactgcctattcaacccttcttccccaacaacccttggcaaccactgaactttttactgcctccatagcattgccttttctaaaatgcaatatgattggaatcatacagtatgtagtttcttcagattgccttatttcacatagtaatatgttttttaattacctccatatcttttcatggcttgatagctcatttctatttagtgatgaataatatttcattgcctggatgtactacagtttatctgtctactcacctatggaaggacatctcggttgcttccaatttcaacaatcacaaataaagcttctgtaaacatctctgtgcagatttttatgtgaatataagtcttcacctcctttgagtaaataccaaggatgtgattgctgaactgcatggtaagaatatgtttaattttataagaaaccactgatttcgatatactctggattcttcgggggatatgtatacacattcagaagtggaattgatggatcctatgataattccatttttaattctttgaagaaccaccaaactcttctccaccagggctgcaccactttacattcccattaatggtatatgtcaaagtggctgtaccattttgcattcccaccagcaatggatgagtgttcctgttgccccacatattggcaagtatttggtattgtcagtgttttgaattttggccattctaataagcgtgtagatatatcacatttcttgttttaatttccatttccctaatgacgtaagatgtggggcatcttttcatatacttagttgccatctgtatatcttcattggtgagatgtctgttaaggtcttcagtccattttgtaatcagattgtttgttttctaattgttatgtttttaaggttctttatatattttggatgagtcctttatcaggtatatcttttacaagtattgtctcccttctgtggcctgtcctttcatcctcttgacagtatgttttacagagcagaaacttttatttttaacaaagtctagcttatcaattatttctttcatgaatcatgcctttggtgtcatatctaaaaagccatcaccaaactaaagatcatctagatttcttcctatgttatcttctgggatttctatttgttgttgatttccaaatcttttattgtggcaaaatacacttaacataaaaattaccatcctaaccaattttagtgtacaattcagtgaatgtattagatacgttcacaatgctgtgcaatcatcactatcatccatctccataacacttgtcatttgtaattatgaaactctatatccattaaacaataattccccaacccccccaccaccgccatctcttggaaaccaccttgtactttctatgtctctgatttgactattctacatacctcatataagtggaaacatacagtacttctcttcttgtgactgctgtatttcatttaacataatggcctcgaggttcatccatgttgtggcatgtgtcaaaatttctattttttttaaagctgaataatattacattgtatgtatataccacattttgcttatccattcttccatggacatttgggttgcattgatgttttaactgttgtaaataatgccactacaatcgtgggtatacaaatatatctttgagactgcttttaatccttctgggtgtatacacagaggtggagttgatggatcagataattctgtttttaatttttgaaggaacaccaaactgtttaacacagaggctgtaccattttgcattcccactaacagtgcacaaggattccaatttctccatgtcccttccagcagtggttattttctgtttatgtgggatttttttgagacaagatctggctctgtcacttaggctggaatgcagtggcatgatcatggcacactgcagcctcaacctagacctctgggcttaggctatcctcccaccttaacctcccacgtagctgatactagagatgggtctcactatgttgcctaggctgtgtttatttttttaatagtagtcatctgagtgtatgtaaggttgtggttttgacttgtatttcctaatgactagagatgttaaacaacttttcacgtactattatccatttgtatatcttctttggagatacgtctgtccaagtcctttgcccttttttttttttttttgagatggagtctcactctgttgcccaagctgagtgcagtggtgccatctcggcttactgcaacctctgcctcctgggttcacatcattctcctgcctcccgagtagctgggactacaggcgcccaccaccacgcctggctaattttttgtatttttagtagagacggggtttcaccctgttagccaggatggtctcaatctcctgacttcatgatcctcccgcctcagcctcccaaagtactgggattacaggcgtgagccaccgtgcctggcccttttgcccatttttcaggtgcattgttttttggtgatgacttttagaagttctctgtataatctggacattaatcccttatcaggtatgtgatttgcaaatttttctcccattctgtaggttgtcttattgcttagttgatattattttaatgcacacaatgtaaatttttaaaatttatctagttttacttttattgcctgtgcaagtacaatttatctatttttacttttattgcctgtgcctttggtgtcgcatacaagaagcactgccaatgatgtaaagtttttcccctatgtttccttataagacttcatagttttaggactttgacccattttgagtaagtttttgtacacagtgttaggtaagggtctcaacttcattctcttttatacatggttaggtaaggatctcaacttcattctcttgagttaatttttgtgtatggtattaggtaagggtctcaacttcagttatcctggcaccatttgttgaaaatacagcactttccctattgaatggtcttggcactcttctcaggaatcatttgatcatgtatacaagggtttatttttgggctctctattcaattccattggtctctacatctttatgtcaataccacatagttttgattactgtagcttcgtaataagttggggtttttgtttgtttttcagacattcttactctgttgcccacgctggagtacagtggcattatcactgcttactgccacctcaatctcccaggctcaagcaatcctcccacctcggcttcttgagtagctgggaatagaagtgtgtaccattacacctggccaattattttattttttgtagagatgaggtctccctgtgttccccaggctggtctcaaactcctggactcagaagtcctcccacctcagccttcaaaagtgctgagattacaggtgtaggccattgtacctggcctgtagtaagttttcaaatcagaaagtgtgagtcctccaatgttgttcatcattttcaagaatgttttagctattcaaggtcccttgagattccatgtgaattttaggatggggtttcttctttctgcaaataacatcattaggatttttattgggattaccttggatttgtagattgttttgtgtggtactgacaccttaacaatattggccttccaatccatgaacataggaggtgttttccctttatgtctactttaatttctttcagcattgttttgtaattttcattgtacaagactttcacctccttggtaaagttggttcctaagtttgttattcttgatgcttttttcagcttttattgaggtataattgacaaattaaaagtgcatatatttaagaacatatttgacctactgtgaaatgattactacaatcaagccaattaacatataccttacatagttgccatgtgtgtgcgtgtgtgtggtcagaatacctaagctatactctcttagcaaattccaagtatagaatatattaactatagtcaccaatctggacgttatgtcaagaacttattcatctgataactctatgtttgtacccttcaacatttcctatttcccctactccctgacccctagtaaccacccttctactctccgtttctctgagttcaagctttttagaattccatatgtaactgggatagtgcagtatttgtctttctgtgtctggctatttcacttagcataatatcctccaggttcatctatgttgtcataaattgcatgatttcctgctttttaaaggatgaatatttcattgtgtgtgtgtatatatgtgtgtgtgtgtgtctgtatgtatatgtatgtgatgtgtttatttgggaatttggtgatacacacacacacactattttcttcctttctttttgagacagggtctccatctgtcatccaggcaggagtacagtggcacaatcacagttcactgtagcctcaacctcatgggctcaagtgatcctcctgcctcagcctcctgagtagctgggaccacagtcatgcacccccatgcccagctaatttttaaaattttatgtagagatagggtatcactatgtttcctaggctggtctcaaactcctgtgttcaagctatccttcaccttggccacccccaagtactgggattacaggtacaagccaccatgcctatgaatactatgttgctcatttcttgactactgtaacactacaatgaacatgggagtgcagatacctcttcaagatactgactttgttttccttagatatacccggaactgagactgctggatcatatagcagttccaattttaattttttaaagaaaatctatcgtgttttccataatgactgtatcaatttacattcctaacaaaaatgtataagggacaccttttctccacatcctcaccaacacttgctatcttttgactttttgataatagcgattctaacagttatgaggtgatatctcagtgtggttttcatttgcatttccctgatgataagtgatgttaagcacctttttatatacctgttgaccatctgtatgtcttctttgaataaatgtctattcagtcccttgtccatcttaacaggttattaattgggttattaagtttttttgctagttatatgagttccttatatatattggatattaatagcttatcagatatatggttggaaatattttctcccgctacatgtgctgccttttcattttgttgtttcctttgttgtgcagacacttttttgtttgatgtagttctaatttatttttgcgttttattccttgtgcttttgatgtcacatctaaaaaattgtcacaaaaaccaatggcaaggagcttttccctgttttataggttttatggtttcaggtcatatgtttaaatcttattcacttttctctacagtgtagggtaaggttccaatttaatttttttgcatgtggatatcctggtttcacagtgccatttattcaagagagtaccctttccccattgtgtactcttggtgtctttgtcaaagattagttgaccataaatgtgtgggtttatttctatgctttctattctgttccattggtttatttctataccagtaccataactttgaaatataattcaaaataagcatgtgtaatatctttcactttgttcttattgctcaagtatgctttagatctttaaggtcttttgtagtttctttcaaattttaggattttttttgtctatatctgtgaaaaaaagtcactggaaatttgataggcattgccttgaatctgtagatcactttgagtagtatagctatttcggcaatatttattctattgatctatgaacaccagatatctttccatttatttgtatcatcttagaatttgttcaatgtttcatagttttcagtgtctaggtcttttatctccttggttaaatgtatgcctaaatgttatgcagtccaatttctctattttttattttatctgtgcctttcatattatatccaaatgaagtcaataccaaatccaatgtcatgcagtttttgccccatgttttcttctaagagttttatagttttaggtcttacatttaggtctgtggtccactttgagttaatttttgtatatggagttaggtaaaggtctcgacttcattctctcacgtgaggatatccagttttcctggcaccatttgttgaaaagagaatccatttgccattgaatggacatggcatgcttgtcagaaatcatgcgttcatatatgaaaggatttatttgggagctctctattctttttgatgctattttaaatgaaattgttttcttaatttgtttttcaggttgtttattattagtgtatagatacgcaaatgacttctgaatgctgattttgtatcctgccactttactgagttagattattacttctaacaggttttttttgtggagtctgtagcattttctacatatatgatgtcatctgcaaacagagacaattttacttccttctttctgatttgagtgtatttatttatttttcttgcccaattcctctggctaggacttccagtactgtgttgaatagaagtggtgagaatatctttttcttgttcctcatcttagaggagaggcattcagcttttcagcattgagtatgatgttagctgtgggctattcatatatggcctttattgtgttgcagtacattccttctatacctaatttgttcatagtttttatcatggaaggatgttgaattatgtgaactgcattatttgcacttatcaaaatgattgtatgatttttatctttgattttattaaagtatcccatttcttgtatatgtacacttaactgtccttatgtactaaggataaatcccatgtttgtgatatatgatttttttaatgtgctgttaaattcagtttgatcatattttgttgaaaatttttaaatgtatagtcataaaaaaatatcagccagttattttcttttcttatattgtccttgtctggccttagtatgagggcaatgctagccttgtaaaataagttgggattgttccctctttgtttggggggaatattttgatcttatacttcccccgctacattttatttttgatgccccaaggtacaccttttaatattgcatatccattgagaaattatgaaaacaatagtaatttttaattatttttcttttaacctttatactagagttatgtgatttatatactaccattacactattagagtattcttaagttgcccgtatatttatttatcagtgaattttgtactttcatatgttttcatgttactaattatcatccttccatttaagcctgaataactccctctggcatatcttgtaaggcaagagtagttgctgataaactccttcaacttttgtttacctgaggaagtcttgtatctgtttcatatctgaaggacagctttgctgtgtaaagtattcttagatggcagttttttatctttcagaactttgaatatataatcctattgtttcctggcctggaaagtttttgctcagaaatccactgatagccttatggaggttcctgcagatgtaagaactttatttatcttgccgctttcaaaattatcttgtcttccattttttacattttgatggcaatatatctaggtgaaacctcttttagatggaaactaattgtaattctttgagcttcatgtacctagatgtccatcaatctgggaagagccccagatatgggaagttttcagccattatttctctgaattaactttctaccctttacctctctactttccttctataaatcctgtgtgaacattaactctcctgatggtgtcccataaatcctgtaaacttcccttgttaccttttcattctttatttttctcctctactggttattttcaaataatttatcctccagttgatgaattcctccttctatttgatcaagtctgctgctgatgctttctatttcacttttcatttcatgcactatattcttcacctccaaaatgtttgttttttttttaggatttctatttctttattgaatgtctccttttgtgtattaatgatttcattaggttgtctctctgttctctggtagcacactgaacttccttaaatcagtcgtttttaattttctgtaaggcaattaatgtatcccaatttcttgggagtcagtccctgaaaattattgtatttctcaggtgggtgctatgtttccttggtttttctgtttcttgttacaatgaattgaaatctgctcacttgatggagtgttaagtaggtagggtgcagcagctgtagcccagatgaggatataatggaatactcttcttgcagctccatcagctgaggtcagcagtggcaaacattacaaaggtccttggtggccaaggctgagtgtcctgatgctgtcgtgtaaatagagttgtgttaataatatccctttcagattgtttgtgattaatgtatagaaatgcaactgaaagctgggcgcagtggctcacgcctgtaatcccagcactttgggaggctgaggagggcagatcacaaggtcaggagatcgagaccatcctggctaacatggtgaaaccccatctctactaaaaatacaaaaacattagccaggcatagcagcgtgtgcctgtagtcccagctacttgggaggctgaagcaggagaatggcgtgaactcgggaggcagagcttgcagtgagccgagatcgcgccactacactctagcctgggcgacagaccaagactctgcctcaaaaaaaaaaaaaaaaaaaaagaaatgcaactgaattttgtgtactgacttactatcctgctactttgctgaattaatttattcagtttttgtggtgagttttcagggatttctacaaatatgatcatatctatgaacaaacataattttaattcttcctttctaaatgatgcctttatttcttttccatattctttggctagaaagccactactatgtttaatataatggctaaaatgcgcatcttgctttattcctgatcttagaggaaaagctcttagtcttttcaccattatgatgctccttgtgggtttttcttctaggagtctttttctttgtccttttatttttagtcaacatgtaataattgtagatatttatgggatatacacagtgatattgtgatacatgtatataatgtgtcataatcaaatcagggtaattagcatattcatcaactcaaatatcatttctctgttttgtgagcagtcaaaatcctccatctttctgtgcctaatttcatttaacatattatccaagttcatccatgttgctgtgaatgacaggacttaatgctttattatgactgaataatattccattgtgtatacataccacattctttctctgcatctgctgatggagatttaagttgattccatatcttaactgttgtgaacagtactgcaataaacatgagaatgcaaatatcttttttatatactgatttcctttcctttgagtcaatacccggtagtggattgtcaaactgtatgatagtctacttttagtttttttgacaaaacaccacagtattttccataatgactcactaatttatagtcccacaaatagtgtattatttcccttttctctgcatccttgccagcatttgttatgttttgtctttttgaaaacagccattctaactgaggtgaaataatgtctcactgtggctttgacttgcatttctgtgatgagagatgttgagcattttttcacatacctgttggccagttgttctattttgcacatttctaaatcagataatctggtgttttttgctgttgaattgtttgaattccttgtatattccggatattaatcccttgtcagatgaatattttctcccattctacaggatatctcttaatagtttattatttccttttatgtgtaggtttttagtttgatacagtcccatttgtctatttttgtttttgttgcctgtgcttataaagtcttacccataaaatcttcgctagacccatatcctgaagggtttcccttctgttttcttctagtactgtttgcttcaggtctcatgtttaagtctctaatcaattttgagttgatttttttatatgctgagagatagtatagtttcattcttctgcatatgatatcctgttttcccaacatgatgtgttcaacatggtgtcctttccccagagtgtgttcttggcacctttgtcaaaaaccagttgtctgtaaataaatttatttacttctgggttctctattctgttccattggtctatatgtctgttttatgcccattgcatgctaatttggttaccattgttttgtatacaagggggattgcttccgagaccccctgtatataccaaaagccatgtatattcaagtcccagagtcagccctgtgtaatgcgcatatacaaaatgtcagtcatctgtatacatagttttcacttttgtgaatattgcattctatccttgttagattatggggaaaatccacgtataaatgaacctatacagttcaaatctatgttgttgaagagtcgactgtattttgatgtcaggcagtgtagtgcctccagcttcattctgcctgctcagtattgtttgtcctatttgtggtcttttgtggttccatgcaagtttaaggattgtgtttttgctatttcggtgaagattgtctttggtatttttttttttttagatttctcttttctctctctctcccttttttttattatactttaagttctagggtacatgtgcacaacgtgcaggtttgttacatatgtatacatgtgccatgttggtgtgctgcactgattaccttgtcatttaccttaggtatatctcctaatgctttccctcccccctcccccctccccccccaccccacaacaggccctggtgggtgatgttccccttcctacgtccaagtgttctcattgttcagttcccacctacgagtgagaacatgcggtgtttggtttttcattcttgctatagtttgctgagaatgatggtttccagcttcatccatgtccctacaaaggacgtgaactcatcctttttttatggctgcatagtattccatggtgtgtatgtgccacattttcttaatccagtctatcattgatggacatttgggttggttccaagtctttgctatcgtgaatagtgctgcaataaacatacgtgtgcatgtgtctttatagcagcatgacttatagtcctttgggtatatacccagtaaggggatggctggatcaaatggtatttctagttctagatccttgaggaatcaccacactgtcttctacaatggttgaactagtttacagtcccaccaacagtgtaaaagcgttcctatttctccacatcttctccagcacctgttgtttcctgaatttttaatgattgccattctaactggtgtgagatggtatctcattgtggttttttgatttgcctttctctgatggccagtgatgatgagcattttttcatgtgtcttttggctgcataaatgtcttcttttgagaagtgtctgttcataacctttgcccactttttgatagggttgtttgttttttcttgtaaatttgtttgagttctttgtagattctggatattagccttttatcagatgagtagattgcaaaaaatttctcccattctgtaggttgcctattcactctgacggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttacggttttaggtctaacatgtaagtctttaatccatcttgaattaatttttgtataaggtgtaaggaagggatccagtttcagctttctacatatggctagccagttttcccagcaccatttattaaatagggaatcctttccccatttcttgtttctgtcagctttgtcaaagatcagatgattgtagatgtgtggtattatttctgagggctctgttctgttccattggtctatatctctgttttggtaccagtaccatgctgttttggtgactgtagccttgtagtatagtttgaagtcaggtagcgtgatgcctccagctttgttcttttggcttaggattgtcttggcaatgcgggctcttttttggttccatatgaactttaaagtagtttttttccaattctgtgaagaaagtcattggtagcttgatggggatggcattgaatttataaattaccttgggcagtatggccattttcatgatactgattctccctatccatgagcatggaatgttcttccatttgtttgtatcctcttttattttgttcagcagtggtttgtacttctccttgaagaggtccttcacatcccttgtaagttggattcctaggtattttattctctttgaagcaattgtgaatgggagttcactcatgatttggctctctgtttgtctgttattggtgtataagaatgcttgtgatgttttgcacattgattttgtatcctgagactttgttgaagttgcttatcagcttaaggagattttgggctgagatgatggggttttctaaatatacaatcatgtcatctgcaaacagggacaatttgacttcctcttttcctaattgaatatcctttctttctttctcccgcctgattgccttggccagaacttccaacactatgttgaataggagtggtgagagagggcatccctgtcttgtgccagttttcaaagggaatgcttccagtttttgctcattcagtatgatattggctgtgggtttgtcataaatagctcttattattttgagatacatcccatcaatacctaatttattgagagtttttagcatgaagggctgttgaattttgtcaaaggccttttctgcatctattgagataatcatgtggtttttgtctttggttctgtttatatgctggataatgtttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctctgccaggctttggtatcaggatgatgctggcctcataaaatgagttagggaggattccctctttttctattgtttggaatagtttcagaaggcatagtaccagctcctccttgtacctctggtagaattcggctgtgaatccgtctggtcctggactttttttggttggtagactattaattattgcctaaatttcagagcctgttattggtcttttcagggattcaacttcttcctggtttagtcttggaagggtgtatgtctccaggaatttatccatttcttctagattttctagtttatttgcatagaggtgtttatagtattctctgatggtagtttgtatttctgtgggatcggtggtgatatcccctttatcattttttattgcatctatttgattcttctctcttctttattagtcttgctagaggcctatcaattttgttgatcttttcaaaaaaaccacctcctggattcattgattttttgaagggttttttgtgtctctatctccttcaattcttctctgatcttagttatttcttgccttctgctagcttttgaatgtgtttgctcttgcttctctagttcttttaattgtgatgttagggcatcaattttagatttttcctgctttctcttgtgggcatttagtgctataaatttccctctacacactgctttaaatgtgtcccagagattctggtatgttgtgtctttgttctcattggtttcaaagaacatctttatttctctgccttcatttcgttatgtacccagtagtcattcaggagcaggtggttcagtttccatgtcgttgagcggttttgagtgagtttcttaatcctgagttctagtttgattgcactgtggtctgagagacagtttgttatagtttctgttcttttacatttgctgaggagtgctttacttccaattatgtggtcaattttggaataagtgcgatgtgatgctgagaagaatgtatattctgttgatttgggttggaatgttctgtagatgtctattaggtccacttggtgcagagctgagttcaattcctggatatccttgttaacttccggtcttgttgatttgtctaatgttaacagtggggtgttaaagtctcccattattattgtgtgggagtctgtctctttgtagatctctaaggacttgctttatgaatctgggtgctcctgtattgggtgcatatatatttaagatagttagctcttcttgttgaattgatccctttaccattatgtaatgaccttgtctcttttgatctttattggtttaaagtctgttttatcagagactaggattgcaacccctgcctttttttattttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcctttagcctatttacatttaaggttaatattgttatgtgtgaatttgatccattatgatgttagctggttattttgctcgttagttgatgcagtttcttcctagcatctatggtctttacaatttgtcatgtttttgcagtggctggtaccaattgttcctttccatgtttagtgcttccttcaggagctcttgtagggcaggcctggtggttataacatctctcagcatttgcttgtctataaaggattttatttctccttcacttatgaagcttagtttggctggatatgaaattctgggttgaaaattcttttctttaagaatgttgaatattggcccccactctcttctggcttgtagagtttctgctgagagatccgccgttagtctgatgggtttccctttgtgggtaacccaacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatcctgccttgctaggttggggaagttctcctggataatatcctgaagagtgttttccaacttggttccattctccctgtcattttcatgtacaccagtcagatgtagatttggtcttttcacatagtcccatatttcttggaggctttgttcgtttgtttttactcttttttctctgaacttctcttctcacttcatttcattcatttgatcttcaatcaccgatatcctttcttccagttgatcaaatcggctactgaagcttgtgcatttgtcacgtagttcttgtgccatggttttctgctccatcatgtcatttaaggacttctctacactggttattctagttagccattcgtctaatcttttttcaaggtttttagcttctttgctttgggttcgaacttcctcctttagctcggagaagtttgattgtctgaagccttcctctctcaacttgtcaaagtcattctccgtccagctttgttccattgctggcgagtggctgcgttcctttggatggggagaggtgctctgagttttagaattttctgcttttctgctgttttttccccatctttgtggttttatctacctttggtctttgatgatggtgacgtatagatggagttttggtgtggatgtcctttctgtttgttagttttccttctaacagtcaggaccctcagctgcaggtctgttggagtttgctggaggtccactccagaccctgtttgcctgggtatcagcagcagaggctgcagaacagcgaatactgctgaacaccaaatgttgctgcctgattgttcctctggaagcttcgtctcagaggagtacccagccgtgtgaggtgtcagtctgcccctactggggagtgcctcccagttaggctactcgggggtcagggacccacttgaggaggcagtctatccattcttagatctcaaactccgtgctgggagaaccactactcttttcaaagctgtgagacagggacatttaagtctgcagaggtttctgctgccttttgttcggctatgctctgtccccagaggtggagtctacagaggcaggcaggcctccttgagctgtggtggactccacccagttcgagcttcctggccactttgtttacctactcaagcctcagcaatggcaggctcccccagcctcgctgccgccttgcagttcgatctcagactgctgtgctagcaatgagcgaggctccatgggcgtgggaccctccgagccaggcgcgggatataatctcctggtgtgccgtttgctaagaccattggaaaagcacagtattagggtgggagtgatccagttttccaggtgccgtctgtcaccccttccgttggctaggaaagggaattccctgaccccttgtgcttcccaggtgaggcgatgcctcgccctacttcgtctcacactcagtgggctgcacccactgtcctgtacccactgtcttgacgagccccagtgagatgaacccactacctcagttggaaatgcagaaatcacccatcttctgcgtcactcacgctgggagctatagactggagctcctcctattcggccatcttggaaccaccccacttactgcaatctttaactcccaggctcaagtcattctccatccttgacccctcaagtagctgggactacaggcatgcaccaccatgcctggataacttcttaattttttgtagagacagggtcgtgcattgttgcccaggctggtcttgaattcctgggctcaagcgatccttctgccttggccccccaaagcactgggatttccttttttttttttttttgaccgatacataatacttatggggtacatgtgctattgttacatgcatcgaatgtgtaatgatcaagtcagggtatccatcaccctcaatttatcatctctatagttaggaacatttcaagtcctcttttttattttgaaatatacattatattgttaaatatagtcaaccaactcttatcaaacattataaattatttattctaactagctgtgtatttttacccactaaccaacctctcttcaccctccagacatacctttcacagcctttggtatctatccttctactctctacctccatgagatcaacttttatagctcccacatatgataataacataagataattatctttctgtgcctggcttaaaataatgacctccagctccattcatgttgctgcaaaggacatgatttcattcttctttggtcaattagtattccattgtatatatttacctcattttctttttccatttatccactgatgtacacttaggttcctgagtccatatctttgctgttgtgaatagtgctgcaataaacacggggatgcaggtacatttttagtatactgatatcttttcctttagataaatatccagtagtgagattgctggattatgtcatatttctctttttaggtttttcagaaatcaaactgttttctatagtattaatttacattcccaccaacagtgtataagagttccctccacatcctctccagcattggttaatttttgtctttttaaaatagccattctcactatggttttggcttgcatttcccttataattactgatgttgggcttttttttttaaatatacctgttggctacttgtatgttttcttttgagaaatatctatccatgtcttttgctcactttttattggaattaatttgttgtttactattgagttattggagttcctagtatattctggtattagtaccttgtcagatgagtagtttgcaaatattttctcccattcaacaggctgtctcttcactctggtgattgtttcccttgttgtgtacaagctttatcatttaatatagtcccatttgtctatttttgtttttgtctgtgtttttgaggtcttatccataaaatctttccctagaccaatgtcctaaagtgtttccccaatgtctccttcattaatagtgatgttatagtttcatgcctcatgtttaagtctttaacccatcttgagttgattttagtatagcaagagatagaaacggtttcatttttcacatggatatcttattttcccagctccattaagtgaagagggtgctcttttcccagtgtatgttcttggcatctttgtcaaaaatcagttggctgtaaatacatggatttacttccaggttctactctgttccattggtctatcagtttttattccaataccatgctgcttttaatgctatagccttatatttttaaatcaggcagtgtgatgcatccaactttgttatttttgctcagaattgctgtggctattccagctcttttttggttccatctgaattttaggattttttctatttccatgaaaaatggcattggtattttgagagagactgcattgaatctgtagattgctttgggtagtatggtcattttaattttgttaattctcccaatccatgagaatgggatgttttttgtgtgttcttttcaatttctttcatcagacttttgtagttttccttgttagaggtttctcacctctttggttaaactcattcctagattttttgtagtggttgtaaaagataatgccttcttgatttctttctcagctggttctttattggtatatagaaataagcctgatttttaaatcctgtaactgtaatcaatttattgatcagactgaagagttttgatttttgtatttcatggtatgagttgtaatatcccctttttcatttttgattttattcatgtaggtcttctctcttttcttcttggatagtttagccactggttattttgtttcttttcaaaaaccgattttgcatttcattgatcctttatatttatttagtttcttgtttagttctgctctgatcttcgttatttctttccttctactaattttatgtttagtatggtttgttcttgcttttctggttccttcaggtgtatcattagattatttaagatcttttctaccttttttaatggaggcatttattacaataaactttcctcttagcattgcttttgcagtatcccttaagtttcagaatgttgtgcttctattttcacttgtttcagtaaattttttatttctgccttaatttcttctttgacccattggtcattcaggaacatgttaatttccatttatttatacagttttgaatgctcctcttatttatttatagttttatgctattgtggtctgagaagatatgtgatatgaatccaatttaaaatatatatatatttaaaatcatacttagtgtcctaacatataatgtatcctggagagtgttccatgtactgatgagaagagtgtatattctgcagctgttttatgaactggtctgtaaatgtctgttaggtccatttggtataaagtgcagtttaaatccaatgtttctttgttaattttttgtctagatgatctgtctaatactggaaatggagaattgaagttcccaagattattgtgttgaagtctacctttcccttcagatttgatgtttgccttatatatctgggtgctttggtgttgggtgcatatatgtttagaattgttatatcctcttggtcaattgatccctctgtcactatataatgacttcgtctctttttagtgtttttagcttaacctttgttttatctgatgaaagtatagctactcctgtttggtttttgtttccttttgcatgtaatatcttttcccattcctttctttcaactatgtgtctttacaggtgagatgcgtttcttgtagatagcatttagatgggtcatgtttttaagtccattcagccagtctgtcttttaagtagaaagtttaatctatttatatgcaaggttattgttgatatgtgagggcttattcctgtcattaattgatttctgattattttgtgtgctttcatgaagttgtcctttcacttcttcctgtaagactcccttaagcattttttgtagtgccagtgtagtggcaattaattccctgagcttttacttttaagggaaatactttatttctccttcatttctgacgaatataactttgctaagtacagtattcctggctggcaggtttttggttttgttttttctttcagcactctgcgtatataatcccatcctcctggcctgtaaagtttctgctgaaaaatctgttagtctgcaggttgttcccttgtaagtgtctacaacctcttttatcgctggttttatgattctctctttgtcttgggatgggcaatttgctataatgtgctgtggaaaagacctttctgaattgtatctatttagggttctgagattcctatatttggatctaaatctcttgggagattgggaagtgttcaggtattatttcattaaataggttttataatcttttggtttgctcttcaccttctgggacactgaaggtgtcaccttatggcatcctatagtcacatagcctttgttcattcttttctattttttctatatttttgtctgagtcatttcaaaagacttatcttcaaggtgtgaaattctttcttctgcttgttgtggtctgttattgaagctttcaaatatgttttttatttcattcaatctattattcaattccagaatatctgtttggttctttttatatctatctcttgggcaaatttctcattcataccccgaattgttttttctgatttctttgtatagtctatcagatcttctttaatattatattgaatttttcaaggtttcatcaatttctttttcactggaatctgttggagaattattgcattccttaggagttgtcatgttttgccttttcatgtttcttgtgtgcttacactggtatctgcacatctggtgtaacagtagtttcttccaattttttgatctgtctttcctaagagagtcttgttcctgaagatatatctatggtgttctttgggcagggcactttggttttgattctgggtgcctgcagtagtgtgatctccatggaatttttttcagctgtaaacagcaccagtagtgtctgggagttcctctgtagtttaggatgcagttgttggtggaggctgtggtaaagtctggctggggatagggacaccagctgggccagtcctcaggccccagtggcagcagtggctggccccgaatgcttatccttgggcccaatggtagtgtatgctggtaccagtgttagcaagtccagggaaaccaattttgggcctccaggcaacttgctcaggtgccaatgatgacagagctgggccacagggtgggtaggtccttgagctctgagcagcagatatggcttgggcaatggcagtagcagtggcagaacaatcttctgcctcccaaggtgtccatgctggtattgggatggctgggataagctggatgagcttgtcccaaggcccacaggtggcaaattcaagtgaatgccagttgtggtggtaatggtcagttgggtagggcagtcctcaagcccccaggagtgctcaggtgccaacaatactggatagggcagggtgatccctaggcccagagatggtatgcgctggcactgggagaaaagagggtgggaccaggccaggtgggcctgtcctgaggccctccagtaatgcaagaatgtactgactgtggtaggcaggcacaggaagatccctgtataccctgctgaatgctcatgttggggcagcagcaactctattgcagccctactcctggggaagttgagtgggattgctttcagtggcagcagctataaacaggcagttgggcaatgcatgcttcggccccaggtggtgactatgggcagggtcacctttcctcatggcagccttgcttcggaggtagcagagtattgccaatggctcatgctttggcctggagggagcagtcaggagtggcaaccagctttgtgtaagggatgtccatggggctccagggatgagatagagggatgtggggcccacagcagatgcagtctggtgggggttgggctatcaaaatgggactttcctgaagttgcctgaggattcaggggatgtgtgaattgcctgaggattcagggtgatctccctctctgggagctgttcattgccatttcacagtctgtaggtagcctcttgttagtctcaaggcatctatgggtcagggggttctctgactaggatttcaggagtctgctgtgggaatgtggaccactaggggctcacttacttacctttctgcacatcgaggagtctcttcatgatcccagccagtcccatagaagcagactgcctgactcccctcttatcccttgcattgggtttttcttattacttctcagttgaattccagcattctctcagaggcgatctatataaactgtggttacctacttgctatattttgtggaggaggtgagtgccagatgcctctagtcagccatcttgaagcccctgctgatatctggatagggatttcatagcatctgtatattgctataggtaaatatgatcattttaacatttttctttcaatccatgagcatgggatgtctcaaaaaattttgtagcctcttcaattactgttatcagtattttatagttttcattgtggaaatctttcacctccttggttaagctttgcttttttttgtagctattgcaaatgggattgctttcttcatttctcttttggctaatttgctgtttcacagaaatgctactgattttttgggggaggcaggggagtgcagacagggtctcactctgttgcccaggctggggtgcaatggtgcaatttctgctcactgcaaccttcacctccgaggttcaagtgatcctcccatctcagcctcctgagtagctgaacttcaggtgcaggccaccacgcccagctcatttttgtactgatgaggttttgccatgttgcccaggacagtctcaaactcctgggctcaagcaatccacccgcctcatcctttcaaagtgctgaaattacaagcatgagccatcatgtccacacctactaatttttgtttgttgatttttttatcctgcaactttattgaattcctttaccagttctaaaagattttggtggaatctttaggtttttctatgtataagattatgccatctgcaaaggacaatatgacattctcttttccaatttggataccctttttcttttacttgcctaattgttctggtgaggacttttcttactctgctgaataagaatagtgaaagtgggcatccttgtcttgttctagttctaagagagaaggtgtttagcttttccccaggtggctgtgggtttgtcatatatgaccttcattgagttatgttccttctagacattatgtgatgagcttttttttttatcatgaagagattttgaattttatcagatgctttttctgcatctattgagatgatcatgtatttttttgtccttccttctgttaatgtgatgtatcacatttattgatttgtatatgttgaaccatccttgaatccctgggataaatcccacttgattatggtgtattatctttttgatgtgcgattggattcagattgctagtttgtgtgtctgtgtgtgtgttttgtttctgaggattctgcatctatgttcatcagggagattggcctgtagttttcttttttgctgttattgtgtccttatctggttttggtatcaagatactgcttgcctcacagaatgagttagggagaattcctttctcttcagtcttttggaattgtctgagaagaattcatgttagttctttaaaggtttggtagaattcagtagaaaacccgtgcaatcctgaggttttctttactgggagactttattactgatacaatctcattccttgttattgctctgttcagattttttttcttcctggttcaatcttgggaggttatatatgtccaggaatttatctctttcctctaggttttctaattgttgacatatagttgttcataatggtctctaataatcttttgtatttctgtggtgtccattgtaagtctcctttttcatttctgattttatttattgggtcttcttggttagtctagctaatggtttattgattttctcttttcaaaaaatcagttttttggctgggtttgttggctcacacctgtaaacccagtactttggaaggccaaggcaggccgatcgcttgagtccaggagtttgagaccagcctgagcaacatggcaaacccccatctctaccaaaaaaaaaaaaaaaaattagcgaggtgtggtgctgcacatctactcagaagctgaggcaggaggattgcttgagcccaggaagcagaggttacagtgagccaagatcacaccactgcgctctagcctgggtgacagagtgagaccgtgtctcggggggtgggggggaggcctcatttcattgatcttttgtcttttttaccttttatctctatttcatttagatctgctctgatctttactatttatttccttctaattttaggtttgatttgttcttgcttttctagttccttgagatgcgtttattaggttatttgtttaaaaactttctaccttattgatgtgggtgtttattgaaataaatgtccctcatagcacttcttttgttgtaccctatacatttttgtatgctgtgtttctattttcatttgtttcaaagaatttttaaatttttaaaatcaatttcttcatagacacagtggtcattcaggaacatgtagtttgatttccgtgtatctgttcaatttcagaagttcctcttgttattgatttccagttttattccattgtggtctgagaagatacttgataagattttgacttttaaaaatttattgagacccgttttgtgtcctaacatatggtatatcctggagaatgtgctgtgtgctaacgaagcagcagttcaaatctaatatttccttgttgatatttttccatccaaatgaattgtccaatgctgagtatgaaatgttgccatccctaactattattgtattggggtctatctctttagcactaataatatttgtttaatatacctgggtactccagtgttgttggttgcatatataattgttatatcttcttgctgaattgatccatttataattatataatgacctcctttgtctcttttttctttttctttttttttttttttttttttttgactcagtattttttgtctgtctactcctgcatgcttttggtgtctgtttgtgtggaatatctttttctatccattcccttacagtctatgggtgtctttacaggtgaagtcagtttcttataggcagcatgtaattgggttttatttttttaattcatttagccagtatctatctttcatttgggaaatttaaattacctacattcaagattgttatcaataggtgaggacttactcctgtcattttattgttttctgactgatttgtatacttttgtttcctctcattgtttttctttgcaattttttggttttctgtagtgataatcttttattccttttcctttctcatttgtgtatctgctctactagtgttttatgcttttgtagtttcatgatggtagatatcatcctcctacttccagatgtagtactcccttaagcatttcttgtggggctgatttagtagtaatgaattccctcagtttttgcttgtctgagggaggcaaaatttcttccctcattctgcttcatttctgaaggatagctttgctgggtatagtatttgtggctagcaattttgtgagcttttccccaccttgcagcacttttaatatggcattcaattctttcctggcctagaaggtttctgctgaaaaatctgttaatctgctgttgattcccttatatgtgacttcatgcttctctcttgttttttaaattctctctttgatttttgacagtttgatgaaaatgtgcctcagagaggcccttttagggttgaatctatttagggatttgtgagcttcctttatctgttagtctctttctctcccaaactttggcagttttcaggtattatcttcttaaatagattttctggtccttatcccaacacttcttctggaactcccaaaatgtgaaatattgttagcttaatagtgtctcatatgtcacgcaggcattcttcattcttttttattgttattttttaaatctgtctggtttattgcaaaacacctgtcttcaaatttagaaattatttcttctgcttgacttagccggcttttgaagctttcaattgtattttttatttcattcatttaatttatcacctccaggatttttgtttggttctttttcatatctaactctgctggatttcccatttagataatgaattgttttcctgatatgtttgtattgtctatttgtgttctcttgtatctcattgggtttccttaagatttcctttactttggagtctattattggagaattattgtgttcttttggcaagtcatgttttcttgtttttttccccccaagttttttgtgtccccaagttgatatctgcatatctggaataacagagacttccaattttatggagtagccttagtaaggacttttcctgtacacgcgtctgtagtatcatttgggtagggtgctttggctttggttctggttcagtgcagaagtgtggtgtctctacaattaattagactataatccacatcagtggtatctgcaagttcatcagtggcttaggctgcttggtgcttaggatgtctgtgaaggcaagaaggctccttagaggtacttactcctctatttttgctgatgttgctaactaccttcaaactttttgacaaagcattttaagcctcttctctgattctgtatgcagttttgcagtgctgggcaggggactagaatgctattggaatttggctcactttgctacccacaggcaatttgaaggtattctttctcctaatactgctaacagcatgggtcatgtggttttatttgcacttactgattttatgcttttaggggaggatgagtgagatgatttatagtcagaggggatgaggagcagcatgctatttttctccaagcctggctgaaagtcttttttaaattatccttttttcttagtacccctttctaatctatcagtatgtcttatcaactctctggatttgcccacacctagtctctccagctatctccctggttaaaaccaccaccatttctctgcctacattgttgtccatacctcattactggtctcttgatttccactcttgcttcctgtactccattcttcacataacagctcaagggagttctttaaatgtacagtggatcttgctgcttccctactcaaatgttccgacagcttcctgtcaccctgtcttgtgtcagtctcacagcacacacagcttaattcaggaattaagctgtgctggtcacttattgagaaagagcttcatggtgggcagctgggaagctgcacagaacactcctcagagttctacaagcggctgagagagctggggtatttatctttcactagtgagtgctgccccggtggtggctcactttccattccttttggcctgccctgtgtgcagctcagcaagtgcctgaagtcagaggtagtgcttatgaaagtatctggtgggcttgcattaagaagctgtcagtgtgaagaacgtgaatgctaagggcatatgagtgtgtccctgagaacatggatattgtgttctttacctccatgtctccagtgcctgccacatagcaggtcctccaagatttgctgatctgcctgccccacctggggtctctgtctctcccacagctcactgacattagccacgtggccctctgtttcctgtaataggccatttcctaagtaagcatcatcctcatttctatacgttttctctgattactggaaattcctcaagtgttgaccattttgattcctgggccccttaagagtccattagcattggaatggagcccacaggaccataccagacagatgccaccacatcttttcttgaagtagtgttcaggctgagggggtcatagccgagggtccctctggggccgcttgctctcctcctactcacagccctcctgcagccagcagcagtgggggagccaagctgagttgattacttttgacatcagttgttaacataattttgatgttgagcctccccccagttctggggtggctctgactgtgtccaggctccaatttgagaagctatggggagcctctcggccccagttctggcctggctgggaggtggcctgggaagggacctgtgtttctcaagcccgcgccctcggggcctgggggtggggccccagcagatgtctggatttggtagccagggcctggagccggatgctgagaatgaggcctgcaactcatttccccattaaacattctgagaacatctgcaccggtttccaaggcttctccctcactaattgctttgattattgtgtgaagttaagaactggcacatttccgcgatgttgtgatgaaggtgaaaagatcgctcttaattagattaaaaacatttttttcttcctgtgtaattttgtcttgaaaatcaaggccacttttttgttttctccatccaaagacctccagaaactttcctccccacctctccagaggtttctggggaatgtcctgtgagctcaactcttggagaagatagtgcttaacccagattccattgtatattaaagtttcctagggctgctcttgctgcctggaaccttcccctgaaaatgtgtcttgggagacctagacagtgacttcctgcagcatggagacccgggtgggtcgattttagttgtgtgggtggctgtgttgctctctttccgtttcctgggctcactcacgctcagggttgaccctgtcctggctctgtcactgcctgtcttcctcagcgcccccgctactcagaccccacccttgggcctgcagagacatttccgttcactctgagatttgtgtatgctgaggcttgctatacttattctaaggagaagtgtttggggtgtggggtgtggtcctcagtatcctaaacttaggttttggaaagcccagcatcctccctgggacttctcaggattccggaagtcatctttgactgtgtcacatcactgtcatgcttgaggcaaatctattctgcacacctttgatccaatgtgagatccaacatgttccataatttgcatcaaacatcctcatacagcagggtgtggagagaggctcactgaaggtttggggagatgaggacttgcatcacagcagtagaaagccaatgtcccaccttaggaaatccctttccaagagttccctgtgctgttgcagggctagggccagggccttggcctcaggccagcttctttcccacaagccttctccctgccctctgccctgaaaactagtgggggcagtgcagaccagtttagctattttgtaaccttgactgcccccaggcccatgtccgtaggctcacacctcacccccaactttgtcatgcacattcctgaagactctcttggtaacaaatgatggaaccccaactcaaacaagcttaagcacaaaagggacattttttggctcacacagctggacccagctgtttcagacacagctggaccccagagctgagatgatcttgctcacttgctctcactctcccctcttgcactccccttctcccttcccgttccctcttttgttctccctttcccttgctctctatccattggccccatgggatggctgtatccttaggcagctactttctaaaaggggcaaaatggccaccagcttgcattcaacagctcaggaagcccagcagaacgaggtcatctcttccaggattcctgccagaatctaaggccaggttcttattggcctcagctggggtacaagccatccttggacctgcagctgtacctccgatggctgaggcaaggtccacagggacccctttggggatggccagagggtacctaaacactgcacactaggagtgggaaaggaagagccccctaaggaagatttgagaagctgttcccagaagccaggcctggctgctggcaggcaaaaacaacaggtgtccactcaagcaaggtattttcctaagcggaactgggtgccagctgtgaatatacattttcactccattcctcgccttgttcctggcagctgttgtgggaatggcttttacactttccatccatgtcccttacttctcgcctctgagtggagacacaggtggtggcggggccactctggctcagggtctatgagccgggcatgggcagctggcacaggctgtggggctgcggctcagcaatgtcacgcagggcctggctgcagctgtccggatgcccctggggagggcttctccttcacagtgcaggatccgcagggctttggtgaatccactgagagggggagatttcttgagggggccagggagggggcttctacttgcaaaggatagggagagcttctgttcatccttgtgaagtaggctggctcagggaactcgcctgtgccaaaccctggggagacatgggtgaggcagaaggcaaggttcccgtgctgagcgccaggcacacataagccctgcagccgtacaggggagggggcaatctccggagccctggaaagcttgtggaagagggcttgggttacacctgggagattaggccggattttaatcaatcaggaggggaagggcagggggtgagtggttgggtgaagttactaggaagggcccagacactggcgagagtctcttgagggcagagggcagcagagatgggctggagctttgagctttgtcataggctggacttggggcttgaatgctgacctaatctgggcagggaggggtctggggctcgatgagaaggcagaggaagtgagaccagaatttcttgggaacagaaagcctcaaagactttcatgataggagagctctatgtagcctcatgggcagctccaggccaggtggagggacatattctggcaactctaggataagatgtgcaaggtcgtgggccagagagcaaggcacagatacaggagacttccacaaattattgtttcttgacttggaaaagtatcatgcaaaatagaaaacacagacacaataaggaaggaaatgaaaatcacccaaagacaaagttaacatttggatctgtttccttctagtcttttttctgtgcctgtatttttaaaaaaataaaattcaaatccccctatcgagcaggaccactgactagaaaggaggatgctgtgctgagtttgattcctgttctcttgagagggtgagacttggcagccagcgtccccagctggggtagtcgccacgcccgaggctgcctttgccatcccagacctcccactttcctagaaaacaaaattgttttgttctgccctgaaaatttaggcccagatcctggccttgacaaagcaaaggcagccaaagaattaaagcatcaaaaaccaggactgtcttaggaaagtgtgacttcattgtcaccaggatgctgtgctctttgtccccagggccagccactctaggcagttcagcaaagggcacctggcattgctccggtacctcctgcagagcctggatatccagatgaactgccctttcaagtacaccatgggctcaaccttctctgcagctgtgagttcaggctgtgaaatacccacttcagaggtgggggtgacaagcaagacctgttagggcacagcacttgccctcaagccctggcctgaaagaggcagcaccagtgtgtctggaaagagctgaatccccacccacccacccccagctcccctccatgctctcctagatgcctgacctggctacgaccacaggtgaaaacagggaagaggtggcagctctggtcactgcctccctgtggtggagaaagcacgccccacagtctccaacacacaagccagcagacaataacctctcctcttgaattggaaaaacaaatctgtggaggccttctctgccccttgttataggggccccatatgccgttcccaggattaaaccaaaaagcacacattcctctctggcaggtgcaggtcccacccactctgggcagccaactgatgtgcacattttaatttcctaaaacaccaggacagaaccttcctcaggggtcaggtggctcacccttggccctcaggctttggagatgggcacttgtcatcatgggtgtttggaaagcaactctacgttctagcctgtgctccatcgttccttctacatacaagtgatgcaaacatcaaaatatgttttttctttcttccttcctttaaaaaaaattgaatcctggatgaagttttagctctgtcacttgacaactgcattatataacctagggtacttgaatctcagccccaaatctctaaaatgggggcagtaacatgcttctgccaggtcccagacctgtgggtctccaaatctgcacattcttcaagccttacaggtccttccctggtctctctaaggatgtcatgggcacagagccctttcactctgagcccttctcctggctgtgactaagtaatgtctgtgtggtttcctgctggaagtctgccactcgcccccacgggccatgagctcctgagtttatttacatttccctgattgctagtcaggcgcaacacctttccacatgctcatcagccttttggattcctcttttgtgatgtgctactttgtctattgcccattttctattaagtcatttatatttttcctattgatttgtaggagtcctttgcattttgtgggcactgtcttttcactctttaaggtgtattttgatgattgggtcttaactctaatgtcaaattactcagtcttctctctcatggttattgcttcttttaaaaaaaaccatcctaatgctgatgtcattaagatattcttctatattcagtcatgtgacctttatagttatgcttttcatagttaggtcttcaatcccctagaatgacaagaatgaatttttggtatatgatgtgaggtaattaagggtccaacttaatgtttttccagtgtgggtatccaactgctcctgaacatttgattgaaaagtccatgctcttcccaggatgtgcaggccacctctgatacacagcaagcttccatatttgtgtgggctgtttcccaatgctcaatcctgtcccattggcctatttgtctctccctgtgtcaataccacattgccctaatgaccactgccttggaagaagtactgatgtttggtacagcaagttctcccaccttgttcttcttcaagaatattgccaattcttggctttttgcacttccaagtcgcagttagaatcagcttgccaaagttctcacacagaagccttgagatttttattaagatttggagagatttattcagattttgagataatcttttcagtattgagtcttctagtcattggaatgaaggcatatttctccatttatatcttcttcattgtctcttactaaagttttacaattttctccagagttcttgcatatacttagttagataattaatattcttttgtgctattgtatacaggttctgttttctcttgttacctcacattttttatttacagaagagaaacaaaaatagtaccgagtacccacatccctttcaccagcttcccctaatgttagcatcttatataaccatggtacattgaccaaaactaaaaaattaacattggtacactattaagctagagttataaatttatttggatttccccagtttaactactaatgtcctttttctgttccaagatcccatctaggatcgatcattacatttattgtcatctctgatcggtgacgggcttctcagtcttgttcttcattaacttgacacttttgaagaataccagtcaggtgtcattgtccctcagtttggatttgtctggtgttttctcaggactagaccagggttataggtttaggggaaggaggccagtgaggtgagatgctttcctcattgtggaacatgacatcaacatggtttatcactggtaatattaaccttgagccactcgtttaaagtggtgtcggccaggctcctccactgtaagtgaatagctgtttttccctttccatagcttagtctttagaagcgagtcactaagtatagcccacactcaaggtggggaagggaggggttcaactctacctcctgcaggagagtatcaaaaaaaatctgcaaatatgttaaaactaccacagcaattaaaatacatttcaaggaagaaactgtgaagtttctgagtttcactaactaatttcagcattcattcatggatcgttttcctgcagcaaatattaccgtgatgtacttctattttcctcattccttctacattttttatttggaattcctttataaggaagatttgtccctctcctccaattgtttatttaattttatcagtgtggatttgggagtatttattttttgagttatagtccaatattatttattttgttgctcaaattgttcaagctgtggccactggtgggttcatgtgtccttttgatgtgccccccgccatccttttcatttatttttaagcatttcttttctagcacttgacaatacttcaggctcatcttttattttccctaccctagccctagaatcatccattcatccagagagccctggctccctggagaatgaatagaaaacctggatctaggcacggggtatgctcgtggctactagggtatcattgcttcagtctcctctcagtggacagagctaggaaatatatgtatgtatgtaacctgagtacacatacatctttacatatctgtatctatataaagctaaccatgagttcatactgacatttctgaccagagttcatccttgccccctcccccacaacttatttatagctttttctctgacagctagaaacctggctcccattacctacagttcatttacttatttgtgtaaccctattgtacacgtagtaccctatgtgaagcaaatttacctactagattagagtgtttaggacagacttttgctttaaccatagagtgtccagtcaaaacagtgtttttgaaagcaacatatgccagctcctcctcctcctttcctttcactgctatgtcatttgtttgtaacacgctcatcatagtctgcttttcatcgtagggtcctccaacatccgggttaattttttaaatttgcatacagtaaaatccactctttgagattcagttctgtgggttttgacagatgtctggagtcatgtgtccacaatccagtatcattcacagaagttccatacccctaaaaataccctggggtgagtcttttgaagtcaagtacttctcccctaaccactggcagctattgatctgttttatgtccctgtagttttgtttttctagaatgtcctataaatgggatcctataatatgtattcttttgcatctggcttctttcactgcttagcaaaatgcatttgagattcatccatgttgttgcataaatcattagttaatttctttttattgctgggtggtattccattgcatgaatatatacattttgtttatgcattcacctgttgaaggacatcttcattgtttccagtatttggtaattatgagcagagttactatacacatttatgtacaggtttttgcgaacataaaaattcaattcacttgggtgggaaaggaaccgataggtcatgtggtatgtgtatgtttaacttaataagaaattgctaaactatttcctaaagtcactgtgccattttgcattcccaccagtaacatatgagagttctacatgttccacatcctcaagagtggttggtattgtcaggttttgaattttttttttaatttatggaatttcattgtgattctaatttgcatttccatatttatgttaattatgtatcttttcatgtgcttatttataatccatttttaaaattggattgttcactttattgtcaagttgtaagcattctttatatattctgagtgcaagtccttgacctgataggtgatatgcaaatattctttccaagtctgtgctttgtcttttcattccattagcagtgtctgttgcacagcaaaagcttttaattttgataaagtccaatttgttgattctttttctcttacgagttaaacttttggtttcgtatttcagaattcactgccaaatccaaggtcctggagattttctcttatgttttcttcaagatattttatggttttatgttttattttagattttttttcagtaagtttgtatgtagtaccctttaaattttcattttctaattgttgatcatctgtcctatcaggcatagatactaaatgcattaaaacttttacacacatacatatgtatacatacaacacattcaaatagtgaaattaggaataaatttaagagagaattgtattacgctgatgtgggaaaaccttccttttttataaagcaaaagatgtatcactttaaaaacataaaacattttctaggataaaagcaacataattcaggtgaaaaaacagactggggaagctatctatgcctcatataacaaggagttaatgtctgtaatgtatagaaaattcctacaaagtgataagcaaaagtgagcaaaggacatgaacaggcaattctgcaagaggaaacccaaacagatgccaagcccataaaaggtattcaacacagatggaaataacagcaatgcctcagttttcatccatgcttgatagtccctgcaaaaggtgctgacaaccttcattcgggcttcattcaacacttcattcaggcatggatgtgggaaagctgggggagcctgaattgctacaacttcttgggaaagcaatctagcaacatttattaaaattactaaggacacaccctctcaccctgctccagtatgtcagcttttaagaataaagatgaatatggcatcatagtctgaataattaagcagcttaaaactataagagcctgaatgtccatgatatacagaatggttagctgtggccaatctaaactgtggactattatgtaatgactaaaataattaaatccatgcctatatacctagagaaaaatgaaatgagcttatgttacagagtgacaggaacagagtcacagtgacatcccatgtgcataaaagcaactcccacctggcatctgctgctcggatgagcagagagggtgggctagggatctagttggcagttaacactgatgaccttgggggaggaaagccattgtgaatctttgaattattccacttctcacagatgagtacttaatccttttgcaataaaatatttaaatgaagacaaatataagccaagagcaaatactgatagtgtcaacagagagtggggagtgataaggatcagtatcctgagctcctgtgtcaaagttgcagaggtgggcccaggaatcataatgtgaagccagctgttggagggactcctgtgcctcattgggggtacaactggttgatgtagcatcgtgttttgaggaaggagttctgtggctgcccccacctcccaggcttgccattcctcatgggtcagaggtcctatcaccccatctttcctgacccactactctgtcaatgtatgagtgtgacaatgtatggtggtgggagctgttgtcccttaccaggcctgtgcctgtcacctctgttttattcttgacccaagtgtcagttgtgaacatgggaagaggcccagaacctgaggtggggagagtcttggacacctgagcacagccccaggcacagttaccactccgaagatgattcactggcctttattctcctcagacactgaggtgtcaggcactttggggccatcttaaacacccacccaccccaacacccaactataaaactgattgtcagggctggagcttccaggcacaagctccactcctcacctggccctgggagctcacaggcctggctccacagcactggcaggttgggtgggaggcctaacgtgctgtccccacactttctcctcagtaaggaagagcccaacactgctggaagtgagcatgccccatttcatgagaaccaacagcttcgccgaggacctggacctggaaggggagactctgctgacacccatcacccacatctcacagtgagtgcctacatgtgcgtgaagggctgggctggaggggactggagctcaaggagtcagacttggtgctggggaagccttgctctctggccagagtgctatctactcgcctagtgcccaccacttgccgtctgcctggccccaacacggaggcaccaggcaagagaggagagcaagggcacttcccactgagcctgggaacatgatcctcttgttttgacttatggaaaaccagactgatcattttccacttgttttcatgctttgagagtctgagattgtttttctctcccccagccccctcccctgccccccaaaaaagagacgactttgttttttagcatttccccatggaaccctggccaaagccatggggcagatgccgggtgcagtctgccagttgctgctgctgtcctcaggggctccttcaggtggaggaaatggctgattttccacgccttccagttggccttcccctgaggcacagctggcctgggatgcatgcccgtcctcccccgccgtcacggcatggccaggccaatccccggtgcccggccacggtgtgattcccctgcgacatgtgactccccgctggggtgcccagcggtgacagccgtgcagcggggtcagtggggcacccaagtccattctggccacagtcccattctggctgctaacccgttggggattccccttgataaatgtctttgtgtcaagatctgtgagtgacactcgcggcccttctgagggtcacttgtggaaactctccttctctctaccaacatttttctaaagggtgttttgttctttggactctctgggggtcaggaggttgtcctgagccatgtgtgtctttgtcgtagtgaggccctgggcctcctgcctttgcagccagccaggtgcaaggcctggccttgcaaatcactgaggaaatcgggacccatggtgctgggggctgcaggtgtaaccagagaactggcagggttgggtagccagaatgaggccacctccagggaaggagtggctatcttaaggggtaattatgatcagacaggacctgcccactgtctttccaggcccccccagttcacagagaggttggcagtacctcatggtgggtagggtgtgaagaggctccaagggagccagcagatcactggaaagcaggggtgactagtcatggacaccctgagaatagggctctgagcttctgggcccctcctggctgggtaaaaaggcaggagcagaggtgtgagcaggctggtagccagatgggctgcccaggtacaggtcagcaccagaaggcagaatgatggcttacactgtggccaaggcctgtaccaagtcctggatatgatggacctccaaagtgatcagtgttagtttagtggctcatgttgtgtgcaatacaggtggcagtgcctgtattgcctcttggctgtcccctcagagaggggactgtcccttctcatccttctggctgcttgcttctcctgttggagctctcgctcaccttggttctcttggtcacggaccagcatccagacatgcaaaaagtcctactgggaggagagggccatcacccacagtccatctagctgggcagccaggccttaccaactcttgggtcttgcaaggcccctgcaggtgaaggtggtgagagaccaggcacttatgtggatcacagccaaacttgcagctgcccagtaaatcaccactatgggggtgagggctgccagtgctggtatcagcacatgccaagctccctggagccagaggttacccacctgcccaagggtgaccccaagccagtgtggctgtgtcatctaggacactgggctgtttcttgttccactccaggatgacagggcctgagagacctgaacatccatccccaagctctctgcccactttgggtctggcacattaccattctgcaagatcctgcagccttttcaggttggcactcccatggcctccagtgataagtgggcccaggcaggtcagagactccagtcattacccaaccaggtccctgccctgtaacttaccaaggcctctctcagagcaggctgttccaaaagtggctgctagatatgagccagcctgggaaggcaggaaggagcccaggcatggggcttggggtgagggatctgaagaggggactgggagagggaaaaacaaggaggttgctgcaaaggggccaccttgaggcattgtgttctggtcagggaagactcagggctgaggcttcaggggagctgggttcctgcatcctcagaagtcagggtacggtccctccagagaggcctgaaggggagagtgggcacgtacagtgtcagggcctaggaacccaggctcctctgggatacaggctgggtagaggccccactccatctgggggagaaggctggcagcagtgggcaccctgtttcctcagggcccaaaccgcctggcggcaggggtgtgggggccgtgcaggtcttctgcccgcattggggctgcattcctccacctcctgcacagcccgcccagtgatgcccataattaaattcggctccagctgctcagggatgcagcgaagctcctgtgggcagcctggccccatggaccctgaactgggaagagaggcacacgccctggtgtgtgtgagggacagggatgtgtgctggggtctcacagggggcagagtgggtgggaggcagttaccaaaaaacatttccatttttcttcagcattctactgatgttaaatgtattaccatgctgggccagttccagaattcaaattaaaaacataaataaagacacattttgtttccatctcgagctctccccgcccgcagggccccagagaggtgaggtcactatagccttgattacgggaaggtccctggggctgggcgaagctcctctttccggggcctgttagccagaggtggggtggggggtgagcaggcctgatgcaagctagggagtcatgacaagctgaggcacggggtacccaggagataaagagtggcgtcgctgcaccccagcctataggtgggccctactgctcagcctcaggaccctcaaccagctctgggcggccaggactcagcctcgaacacacctttcaggcagaagctgtcttcctaggttgaatggggcacaagagagtccctgccagcctcaaactccctgagcctgtgtctcccacccagaaccatatgacagggcttctgagagaaaggtgggaagtagagactgtaggcctgcatgggcagttggggagcacccccatgacaagaggagccctgtaccccaagagccaggatgagttcctgggattctgacccactcactatcctctgctcaccaagggtcactggcacgacagtgggtggggacggtgccatgcctgtgtgcatccctgtgccttgcgtgtggtaacctgccatctagaatgcccttgtcacccatctgcagccaccagatttccattcatctttccaacgtctgctcagtaaaccccccaggacacacttaggctgtacggctgtgtcctcctttggctctcaaagccctcagtaccagttccctaagcctttcgaatggtgccaggagggagaagggcatgtatagccctcttggtctcttcctccccagaacccccaaagccccaggcatggagaagccctaggattgctgctcactcaaccctgcctaagatgaagcaaggactgcagacacattgtgccagtgctgaggcacagggctaggggcctgaggatctgcggctctgaacttgggggctgtgtgcaggtgtggcctgggtgagcttctccaagcaaccctgggaggctgaaatcatttttgtgaaatcctccctcacactgcatccccaactgccaagccagccaggactggcctggaattcacacgtctgccccattggttgcacatggatacctgagatagacggcccaagaggacaggcccataagccctgcagcctatggctctgcccagcccagtcatgtggtttctctgaagggcccctgtctcttctgttttggcatcttagatgggcaagccccagctcgaggttaacagataccgccctcagtcccactctccagagggacactcagggagcacccggcccattgagatgggcatgggggaggaccaggacccccgaggctgggcagagggggtggaaagaaggcagagggaaagctgcagagacccccaccaggtgactgtgagcacctccctggcaagcatgtgcttgcctggcctcttgtgacatgacagcttcgcaaatccttgagcaaaaacagccccgtgtgcgttaattagaatttccatgtcttcaactttctcctggaccctgcagaatctcacgccaagacattcgagttgctcttttccagcaaggccgctgtggcctggctttcatccacatcactactaatgtctcctgaattctgcatttgtcagcaaggacagggccagtctgtgctgtctggaaataagggcaaacgtcacaagggtggccccaaatttggcttcatggaccaaggggctagctcttttgatgggaccagcttggcctgggacattttggagacatccaggtccactgtgacctactcccacagaccccagggtaccaggcactgcagctctgtgagtgtctaagctcctcaccatatttctctccctgtaaactttggtgggaaaggacagaaaggacattctgggaaccagtgtccagaaggatgagtgaggggcttgtcaagaacagatgagaccattttgtctttctagaccagtgtcctgtcttctgcaaagctccagaccacctctgtctgcacgagatgccaaggaagccctctgggggcccgcccgggagggctgtacagggctgcatgagtcataggatccccgtcagagccccacatagccccagccaggctcaaacccgtctctgaaatgcacggggggattaaatgttcttctaattaaattaaaaccgaggcgtaatggctcagtgggaaagagatgggattgggaatcagatgccctcaatctggcttccagcctgccatcagcccagctgtggcggccccccgtggccccctaacctttccaaacttcacttcctccgtctgagcacgtgaggaagaagcggctggcctagggctgctgctatggggagagggccgcactgtctaggtggatggcccagaagaaagcagtgaggcttctcatttcctctgcaagggaaaggccatccaaatcaccctgccccagtgcactctggccaggctcagccctctccacttgtgaactcccagccatgatgctgctcaggtcctcagccaagcagatggtgttggaggatgtgacagagagaacattcacgccacagaggtggctggagggcaaaggacttcacaactgcactgatattgtcatggagacacttctggcagttggggcagggggtcggggcggggttgggcggggggcacatcccatatagatctcttgtgtgctctgctgatacctgaaaggggagattgaactgcagagcctctggaggctgaagcacggaggtgacctagtcaggaagtctggaagccgtgtccccttaagtgagggagtgggatggggctgggcctagcggccctgaaggccagggctatccacctaattaggctcacctgggctaccctggtatagggtggtggtgttaaacttttagttaaagggtaatgtgcatgcacacagattagtacacaggtctcaagtgcgcagcttgaggcatcttcagtccctgggacccatgtgtgcagcacccggaggaagcaacagaacccccagaaagcctctcaggctcccatttcctgtcactgaccttgagattaaccacaggcctaactgctagcagcaaggaccagctttgcccacatttgaactttatgcggtgggaatgatgcaactcatacacctttgtgtccaatgtccctcactcaatttgatgtctggcagcctctctatggggctgaagggagagtgctccctcatgctccttgctgactggtgctccattgtgtgcatggcctacatcattcatccattctaccacctgtggccagcaggcagtttctggtgtaggttgctgtttaagaatattctgtacatgcttttggtgagcatcaggttgcgtttctggggaatatatgcctatgtgtggagctgcagggtcctgggtgggcatatgtttactcttagtgaatactacccagcagtctaccaaaggagtcattccaattttcattcccacaggcagcattctggctgctccacatcctaacacttggcattttccgtcgtttccttttcagccatgatggtgaatgtctagcagcatcaaatggtgattttaatttgcagtaacctgttgactaatgaagttgagtccctttccatgttatcatttagtcagatacatcattctgtataaattgcctacatcttctgcctgttttatgtttatttatggtcctatatatctttagatattctggagtcatttgtcagagagagagatacacacactcacactctctcacagacacacacattgcaaatatcgcctccccctctgcaggctgccttcttcctctcttgatggtgtcttttgatgaacagaaggtcttaattttcatgtggtccagttaatcaaacatttcctctctggatagggctgtttgtgtcctatttaagaaactttgactactccaaggtcataaagatattctggtttattctaaagctttattagctcacctttcccatgtagatctgcactccatctgggattgatttttgtgtccaatgtgaggccgaggtcaaggtccactcttcccctacttggatatccagtctagctcagcacccggcatgggaaggcccgtcctctcccaactaccctgccgtatcagtgtctttacaatcagctcactggctacgtgtggctctgtttctggaccctattgggtgccactggtcagattcaagttgttctttgtggccaggaccttgcttccttctcactgtagtttgctaacaggttttgacagctggtcctgctggctctggctgcttctccttccccatcactggctttgctgtctttgcagggtttctcctcaccatacatatgccagttgccatggaaagcctcctctaggcgcagcagcctctagatgggcatgggagaatgggtatccttatagttttggggctcctgaaacatggcatcatgtgtcccttgtttatttaggttgactttcatatcttttaccttgccctgtagttttcagtgtggtggtcatgaacagcttgtcagattcattccttgtcagctaatggtttgatgtatgttcgctgaatccagggacaaggtctgtcagggagccctggccagcttgggtcatttcatcctgcccacaggacactggggcagtcacctaatctctatcagcctcagtttcctcttgtatacattgggagtatatctcacagtattagtgtaaggccttgaggagatggtgttaggcatccagccacatacctgactcggggaaatgcctgaaaatattagccagcatagaatgtctctttgtgatgggagatcctgtggggacattccttatttggcctgagagcttttgagactgccaggtcatgagttaccatgggatacaaatggggtcacaacatatggctgtcagctgctgtccttaataagatgtgcctagaggcctgagagtcccaagctccaggacagtctggagtcaggtggagggaagggaagtctagaggtccccaagtcacaacctcaaatctcggaatggggttcaggagctgttggggtcccgtggaggtacaggcggaaacctagcactcactattctgctctggggagggggttggaggcagaatcagtggactgtgtctcatggcagtcacaggtgccccagtatgcatctgtcatttgttcttatcactgtcgggcccatctgccaaggcaagcacccacattaaagcagagtgaagagcagggcgagctgtgtagctcacctgcctttgaccctgcacatgacgggcgagggaagaggaccatggtagcttgtctctaggcaacccataggtgcccaatggagagataatctcaaatatggtagcagagttcagactcagtggctttcagatggttagtataggctgaaattccaagagcattaaccagacacctactatgtgtatttcttgtgttggggttaggagatactgctgttggctgagacacacagcccacatccttggtaggtccctcagagagcatctagtgggcctgtcctcccagctcacagaaggggaaattgaagcctcaagaaggatagggacttgccagtatcactgggagataggagcagaagccagggctcattcccagacacacaatctctgggggagcctggatatgcatggcagaggccaggatgaaccctgaagattggtaggaaggcagtgtagcagtaacaagacaaagggattctgtggcccatggagcaggagggaacagtctgcagatattatctgggcactggccagtggctcttgtggctgccctctgcaataagaattcttcaagttcagcctctatgtgcatcataaacctggtgccaccagccaaggaggtcaaaggtcctcactggccagtgggccactgggaagcctcctggattgcctggacaaggctgacctgccctcccaggatgcaaattggcaggcccagcttcatgccttcttatggtgccccagagcccctggctaggcattcatgctttagatatgtgggccctgttagggacaacgtaggtgtcctgggcaggggctgtatctgaggcacacatccttggtagtgactggctagcaggaggaagtctggcagttagtctgagcagttagtctgtcaggcctggttggtcccatgggaggcctgaggtgccatcttagaaatagggccttgttaggagaaaaggaaagaaaaataaaaggtagagagacagaggtagacaggagtccaggtctgacctcaaaatccgatgtccccaccatccccagccccttagcctctgatcttctccataagtaatcttttcccatgtgtggctgcagcctcagaggctccctctgaagatgacactgggaatatcctgaaaaaggtacaggaacacctggcatgcctctcccagggtactctggatgtgcacccagagattctcccactttagcaggcagaagagcaacccagcaggggatatacacaaagatctgagaaagggattatttttagggccaattcaagggatttttcaaaggttaattttgactctgcctgacttatctcctaagtctttggcactgagcatttatacaagatcagactgcactgcaccctaagtataaaccttgccacagcagtgtcctgtggtgccctgctggggaaactgaggcagagagcaggggtgactttgcaaggcaatagagggtacttgggaagtagggtggtaggcaaggcttttcagagaacaaggagctacatacacatacatgcatgcacataatcattctgacccagtcagggttcttcccccaaataaatccctgcaaccccactgtggttataggtctgagccttctgccccagggagccaagccctggagaggaggtgggcagcaccaggcagccagcctgtgggccccgctatgcttcctcaggcagctagtctctgtatctggggtagaaagagtgggctaaaaagtcagctagcacccctgacttcaagtcctcgagtgtatgttgggcttgtctccctaccctggcccggtctgcactcaagcccagtatcctcccctggtccctggtctggactgagcagctgtcttctgcccacaggggacctttcttctcccacctaatcctccctctttgggcctttcaaagttgggcttgtttttcagtgttttctttaggttcatgtcctgatttgttaagttaaattgaattccttccagtccaaaatactcaaatgcttttttctgcttttctttttgaactgccccacgaaccccaccagctgggtgtgtgggctccaggtgggagctcaagggggcctggtgtggtgggtgcagaagcagtgtggtggggcagccttcacaggctgatatgattgagctcaggctggtatgggttaggggatgagagtacagaacagtccaccccaggggctctgaagagcttcaattgagatatccttccctaaggtccccacattccatggcagtgcctaggagctctgtgctcccaggcctctccattaccagcctgtcttccacattggaaggtggccttatcaaaccacatggcctgaattttgattgggaaagcatccctgtaggtgtcaggtgatggaaggactctgggtaaatggaagcactgagaccagatatgataggaccttgcccagtggacacagccagctgatggcagagccaaggccagatgtcaggttccagactccaagttctatgcttttttgctggtccagcatggcctgtctcctccccgcaacagatccaaccagtccccttcagaagggctggaccaagtgaccccaactctgggttctgcctgggcattttcttgagtgtcataccctagccacctgactgtcaggggagcagtatgtggcacttgaggccttgggctggccatgcaggcccaccacaggtggcaaggaatcatgaaccccagctgagtcccctgcaggccttgcctaaaggagaagccagtgaatcaatgtgttacttgaacaaatatagggtctagggctggccaaaagggacagtgaagttggcttctcaggccacagtaggccttcacggtactcagcaggagaccccagcaggcagcatcagggcaggggtgctgaccatccctgacccaagcacgaggatcagaatgggccctggagccaaggccaaaagccgaactgtgactaggcaagctgagtcccctgtagattctggggactgggtgatgcagactgcaaagcctcagccaccttctcccctagaagaaatcttgagagaaacaatcccacaggctaccaggccagcttttggaaacagtctcattagcaaacaaagggaagtgacagagcagagctccccttggcctttgtttagcccaccttctgcctaggcaccaggcctggaggttccaacttggtgttgggcctccttgagccggaacacctgaaaagccatacagactcctgctcatcacaaccacttgttgatgctgacagcctgtagaaagattgctctcagcctatcccctccctggccatgcaggtggaagaccctattacttgggctaaagagaagctaaacgtgaccagcctacccaccttgctactgctgatgaccaccctgactcatgtcccttgtctgcataggtgttttcctataaatgtttaattcctgaggttgctgaatctcagggcttggaaggcccagactggacaggggaaggggtacagtcccttcttgctggtatgttgggaagctctggtgcaaagggcagtgatggcccttcaatcccaggcccacaagcaccacagccaggagagtcaaggttggatatgaagagggacttcctgaaagcaggcacaggaagggatgggagctcagctcaccgggtgctagacaagggagtgtgtctctttccccatgagtgacagcagccacaaggggatgcccagcattgggggtggggtggggggagggccctccgtgctttctggctctttgggcctggggtgcagcccctcatttgtacttgctggctgccccatgggggcttgggctaggtctccctgccggtggggagggaggtgtggaagctggtttgccggggccacccagtgtgggctcaggaagggaaggaatgtgaccaaggctgggtgtggctggggagagcacagccagttgtgggtttttcttggggcccagatagatgtgagcagagctggaggcccctctctcccagcccccggcacacacactaggacctttcttcatcatgcagccgtagagctggaggccaaggacaccctctggaaatctgaattccattcgctcttggcaaagagcagcttcctgcttagggaaggtgcatgcgtgcgtgtgtgtgtgcgcgcccgcgcgcacacgaccacagaggctggggggaggcacgtggggaggagggctgcctgtcgagatgtgtaagatggccccagtgttactaggcactagatggcacttgcaaagcccattcggaggatttagacaaatacctcgagtgagtgaatctgaagcatgctagttgtgttgccttttaaataggctctggcttaaaacagtcacagcgaaacatgcctttgaattggaaagccagaactttttgcaaaataatttgaaaagtttgttgaaccttaaacctttcctgatgactccttccttctgaacttaactcgttaaagttgctccaatcccagcccagtgccagaccagcttcctggaaactctcgccaactgctggcctttggaaaggcttgtcaccctaatagctgttttttaaaaaaaaaaaaaaaaaaaaaaaaaaaagctcactgggcaccttggctgcagggtctgaaaagtcctttgtgttagctccagctgcagagtttttccaggcctcgcttctggggctgactggagctgtttctcttcgtttcctcttacagtggcgggcactcagccggcttcttcccgcctgacttctctgccagagcccaggtgggggacggggatgccaagggcagagcccctggagaggctagtgtgggcatgtcctgagtggacagacctgaaggtgggttcactagcctctttctcccatccttcaccctattagaggtagtgctctagcggggaaagattagggcccctctaggtcaatattgtgtcatttccccagaatagccagggccaaaccagctcccaagcagtactgtttcagaagtgaagataactcacctctcccaaaagcagagttttggcaatataaaacatgaaagtgggatgggatctaagtcatatttttttaatgagtttaaaacacgtgtgtgcattagaaaacatttaaacacagatattgggcaaattaattgaaaaatatattgtcattttgcgttaaaataaaagatgatctgaaaatggaaaaaagttacataaaaacgtaaatatttcatgagacatagcagtcacaacatgccatacacatttcttccagaatcactccactggaaattctgtaataagacatacgtaacagtttcacttcctaggagatcccaattgctcctcagatagggtggagagcaccccttattagagggtggttgggctctctaggagcccgcccagggcctgccctgactctggctctgcctttccctgtcaaaaacctctttgtgctggagcagcccctgctccacagagtgacatgaaccagagactcacagcactgtgtgcggggagctgctgcccgcagggcataccagccacgtgcatgcagggctgcacactgccctaccgtgcatccactgcctggccaacacctgccttctggggagccaatcgtgctttatgtattcaagggttgtgctacaaaaatcatacaacagtctttacacacatggtaaaaccaattcagagtacaaaaggggtgaaaaataacactctccccacccaaccctaattcccaagtttccttccctaaaggttaccactcaacactttcctattgcatctttccagacgtattttatataaacaaatatacgtgtgtctgtgtgtgcatgtacttagtagatacggctcctttttatacaaatggtagcatactgtatgtatttttctacactttgcctttgacttcttccataggtatgccatacttctttttgagctgtacatacaatgctgatttattatggtgcagtacatctgagaagcatttttattgcaaaatgtgtgtttacatgtatacagacacacgtgtgaacaggtgatggctctgaacagtgtagttgaagtgctgttttctcatggttgggcttccagtataattggaaggagcatagtctctgtgttcagctagagatttagcccaatgggctgggcttttcccagataggacatgctcactgttctgctcagattgttagctgtagtctttctggcatcagttccatttctggtgaacacttggacttggcaaaaggcatagaggtagtggtacaggaaaggtctaagaaggctaaggaccatcatactgggtattcaacagccagctctccaaagaggcctctaagaaatgggtagcttcacagattcacagatagatagttcattaaggtcttgagtatttccaagggagcactaactggactacagcctggcaggagataaccaagtcatatgcatagtggctttgggtacgatggtctgctgtatgaagcaaccctaggacatttgaagagaatggagtgatggccagtgtattgtgctgggatctaccacaggggtcatgttgtaatgacacctgtcagctttgactggggagccctttcatttcttagtaagtgttcagccccagtgtgcaccacttaaaaggaagacactggtatgttctggagatggatctgtattaagacatctagcaaatctccttttcattaacagctgcagagtttcattgtgccatgatttatggaacagatcctctgttgatggatatgtagggcagctaaaaaacagcagccattaaccattcaaatatattcactactgaaatgaccacttatgaaattagtttccctgaaacatccctccctattgaacactgttgtttctccctatccatcttatccctacttgtatctctgctgactgacctctttggctgtctcttgtcaaccaaagacaatataaagcacacacaaagtaaagaggaacttataaagaggaactgtaaatcttgtcaaaataggagatttcatcaagttaaagaaaatgatgtcaaatgatttctcaaatagagactgggcagagtagaccagttagttaatcagttgaagaggaaaccaagatcgatgcctagataagcatttcagaggacagcaggggagatgataattgatgcaggtggcctcttggtcaagcagtgaaaccatgccatacttctacaaaaaatgatcctctctgtggaagtgctgccaacatcctctgccaagtataaaagatgccctcagatgttaccatataatgctttacaaaagacaaaccaaaatcccctctggatttgtttttttctaaaacgtgtacataattgtaactctaacaactgttattgcatatgagataaaataatattttaactactgttatttttcaaattaacttcccaatcaaatatctctattgtaaaattttggtctccgttttcagtggatttactttaagagatcctccctttccccccatttccagcaggattaaaatgttcatttatgttgtgatagatactgccaaataagggctgtaccatttacatcactttgactgcacaaatgcactttcttcccccacccttaccaagtgtatactcaggtttttatcttcattcatttcatagatgagaaatggtacactggagctttaatttacatttcttttgttggaaatgaggtttttatctttccaaatgcttaaaatcatttgtttttctttcttgtgaactatttcttcataccctttggactttgtaaaataccttgtcttactgatttgtagaaacttgctttgtcatattcattgaaaatattttatcctcattttccttaggtgttttggctttttctataatatttttctggtggcagaatttttttaatttcacatagtcagctgtgtcagtcttttatggtttgaggtccttatcttaaattctgaaataacctctcatcctgaaattgttttaataaattcttccatgttttcttctatcattttttatttcattttttacatttaaatccttgctttatcgggattttgacagagtaattaaatccaatttggtttcccatatatttgtccagttgtccaacactatttatttgagtacatcatcatctctctactaatttcaactgctacctttatcatatttcaaactctcatttaatttgtgtccatttctagactctattctggactgctgatgggcctgttgataggccagagctcagttattttaattatgtaactttatgatgcacttatctgtgtagcaggactccccctcatctccattacttaagagccaataatgggaagctcattttcacaaatgcagtcaaccaggggaattcatggcatggcctaagatctaaacactcttaagatttaaacacaggattagctcttgagttagacaggaagctggggtgtttgggactgaggcttcatcgtggcagctaataatgtcagggagcatgagcacttgtttcttccaaggctcacttcaaggaaggcagaatccaggtcgggggtgcacaggagttgccagctggacccaaggaccatttcgtatacatgtatgatcatactttcagggcatcttggaaaaactgaatttgctaactcaatagagaacaaaagagcaaataggcctaattcaagaatttttaaaaacccgcaataagaaacataatctaaaacttgtagcccagcccctcctccataccaaccaccaaaaaaacccactaacaccataaagtgtcatagctagagctagagtgctgttataagctgtgcaggccaaaatggtttcatggcatgagttgggcagcagcgactcagtttccatgtctgagttaggccacctgtaacaatgcagccccatccatgtgaagctggtccagaggactacagctgcctgtcccacccttggctgtgctctcctttactaatccatagccaaagacaggggctaataacagggtctggagtctgaactcatatcctaattccactactttctacctgctacaccttgagtgagtcacttagtctcagtttctttatttgtaaaatgggaatcataagagtaccttcctcagagggttgttaggaggattacacaaattaataatataaagtatgcagaaaagtgcctgtcctatagtagtgacacagtgttacttaaatgtattgctatacctcatgatggccattccatccattgtaatcatgtgtaccatgcaattcacagtgcctgacaaagctgatggggaggcgagttggaatgaatagtatcagcatcagaaaaaatacaagtgcatcctcataagattatttaggatgcataggatcccagattagattttttttaaatcagccgttctctgtattcttgtccagatgctgtggacagtgatgatgggaaaatagtccctgctgcacactagggcctgttaggccagttgagggctagaggagcacaaggggccagactgctgctacttctgaattttataggacatgcatttttttcatataaacttagaactagcacgcctaattttttttttatttttattttttttgaggcagagtctcactttgtcacctaggcgggaatgcagtggcacagtctcggcttactgcaacctctacctcctgggttcaagcaattctcctgccttagcctccctagtagctgggactacagacatctgccaccatgactggctaatttttttttttattagagacagggtttcaccatgttggccaggctggtctcaaactcctgacctcaagtgatctgcccgcctcagcctcctaaagtgctgggattacgggcgtgagccaatgcacctggcctcagcttgcctaattaaaaaaaaaaaaaaaaaaaaagttgtctatctgtgtgtatattcatatcccattggcatttgttattgaaacttcattcaatttagattaactgatgaagaattgccttccccacctcaaaaaaaaagtctttccagccacaaatagaagcagtttacccacatgttcaaatccattgcaacatccttccatatttttttagatctttgtatggattttggacattctaaaattcatttctgggtatttttaggaggactactgatttttttttaatttgggcattttttaaaataaatttttattttgagataattgtacatttctcatgcagttctaagaaacaacacagagaaatcttacatactcctttacctagtctcccccgatagtaacatcttgcaaaactgtagtacaatattctgaccaggatattgcattgatagtctcactacaggacatttctaactcttcaagaatccctcatgtcccccttttatagctacccccaattccctcccaccctaccctgtccttagcccctgacaactactaacctattcttcatttctttatcattccaagaaaattatataaatggaaccacatagcaaatcacctttttgggatcggctcttttcactcagcacaattccctgaagattcacccaggttattgtgtgtatccttgcattttggtatgacccaatttgggtttgtatttttaaagctgatggacactatttactagtgttttcaagattgcactgaccatcataggtgaaataggtatgtgttcttttattatgaaagcctcctcagatgtggacattagtgaaatgtgggctccaaaaagagactttggaagatttcactaatgatgtggttattttttaaatagatgccccccaaaaaagcacctatgaaaaaattcttacatagcaattctacttctgaatgctaagagggtttggaaaaagtcatttttgcagtgtttgtgttctatgaagagtgggtagaaggaagcaggagagtattcctgcctccccaggagagagcttcactttctccctataccttcctgtcctaccagcccacctggttctctgtctctctccaactgtgaccgtcttttccttgtagctccctgctcactccatgtggaggatggctcttggggctggggtgactaaaggcaaagaatggggatccctgtgacagctctaggggattttgggaccagataaccttaatggcctcaggctccctagatgagaaatgggacttagtaaagtcaaactggtccaggttaagccagcccatgatgcctggaaggaacttacccttttctagagtaacttcccttttcaggaagtttctagcttgcttgctcactcgctctccccacccccacccaacctcccccaacctatctctccctctctcaggagaaggtgctccctcacccttaaagaccaggctgccgttgcttcccatgtgtctgttcctctattcagtattgtgggcactgatcacacaccagggcactgtgggggccctgggacctgggaggaccagaatgggtacagtccctgccttctcaggttatggtcatatcatccatgctccccaaacatcaaggtactccaaaggaggcccagcactaccatctaggtggggagaaaacacaccggccataatgaacacacgtttaggctgaagaataatcttcaaatgatactactacttacacttcctgtttgccaggcaaatatagacatcatttcactaatcctcacagcagcttttaacacaagaatattatcactcctgttttatagataatctcctaagggttgagggattgagtctagggcccagggtcacaaagctagggagccgtggatctgcaggagatgtcccagctcatcaaatattctttcagtattaaacatatcaagctctctcctgaccttctctccccttccccaggccaggactgtcttatcctgtggttcttagctgaaatgtcccttcctcagaggagccaatttctaaagcttaagactgggctgtaaaaaatcacatacctcccctcccattcttaatgtgtaactgtgtgtttatttgtggtaaagggtttactggctggctccttctatcacattcaaggagcatgagggtataggctggctgtttctattcagtgttttatcttcagtgcttaatccatatggagcctgtcacggaccctcagtgaatgtttgacgagtgagtgagtgagtgagtgagtgagtgagtacttgtgcccaggtcaaaccaggtgctaggaccctggcaggggttccataaggctatgctggggttcaggcaacccaaggctggtctggagagtgtaaggcttgagagctcttcttcaggctcagtcatccctgcttccccagggctcatgtccacatgctattgtccatagaagctggggtccaaagttgaccagaatatctctagtcataaagaatctcttccccttgagcccactcatctctgttgacattctagaaatgcagggaaatctgggcaccatgaaatgcagtgacttgcagtgatcctcctggggccttgtatagaagagaccatctcagttttgtagaccaggaaactgaggcttggggatagcagatgttcccagacagaaaatggtggcacctggagaggtgctcaggtctgtgtggaagaaaggacaggagtccttctgccacccagactgtgcattcagacatctcccttgtgctgtgcagccttagttctgcctcctgagagaggtgaccttctcccacttcttacaggcaaggctcttgctagcctgaggaccaggagccttcagattttcttgttcccaggatatatcgcaccaactcaggagggtgtggggatgggctagcattaggaatgggtattagcatctgcattaaaaggctcccactgacagctcatgcattgtgatggaactagaggtgagatacagagcaggagtccatggcacctccagaacctgtcagcctgagtatgggcaatggcgttttagtttgcaaaaccagacacatagaggccaggtttcccccgctcaacactaggccactgtgcctgccactgctgtctgcaaatgcaggttcctggggctctgggtggtttgtccaatggctaagctttccccaggaatgggtaactggaaaaatgtaggaattacatatgattccatcaatgacagttttcctattaaaacataacttgttaaagcatagagcttagttcagagtaaacatttctaaaaaagaggtagaagcccctacctactgactggcatcacaaacactgccctgaaatgccaactcatttcaaatactgctctagacaactgggccctgcatctgctgcaaggaacatcccttactttcccatctcaatacaactgtgaaaagcctagcctgggactcaggcctttccttactccctctggttacctagctttagctctgaggcagcccagatgacatgggcctctaaggctggctgctcttactctataccccaaaatcccagccactagcttgcagaatggctttgttggattcccctccctggccccacactcactgctacatctctcttccaaatcataaatgcaaaagatggccaaaggtgcatgctctgtgacacgtttcatagtcagacaaaaccagctgactgcttttacttttttttttttttcatttagaagaatttccttggcaactccgtctctccttagtcaacatcagctaacttcatcctccccctttatcaagacattgtttagagtaaataattcattaactggtacagcaatttcagaaccctttcacatagattcttaaggggaccgtttcccttgaagaatggggtacaccagaggacttaggaagagaagcgcccactggggcttggtcagactctgccaggagacaggcagctgtctgttaactgaccctacccagtaccttctgggattggattaacaaaaggggagttggttaggctggagcattgcaactcatttcttccctgcagtctctctcctgaggtggcccaggtatgtgtttgaggcctgggacttgctgccagcatgagacaagctccagtggggtccatccccctgattcctcagtgccccagcaccacctctttcatttgaaaacgtgttcttttggcaaaaagactatgctccagaactttctggctgagttctccttctattcctcctattccactgttaggtgttggaaaagcaatatatttgatgctttctccatgtcccataaatgactttctggcagaggagagtgactgtcctttgtctgtggccctggatttgaggctaagccttccttgaagaaggaacaggaaagaaaggcttgttggatgtgcagggagctagtggccaactgagcacttgctcaggcggaggggcctggagagaacccagggtaggtctgcctgggagaaaaggggtaagggaggactgcctcccagccttccctccccactggtctgggcacattccaaggcttgaggtctcctagtcaaggcctcctgttattggcttcctccagggagtctgctgagacaaaagttttagattctttcactacatcataaggtaggtaagtttgtgtccctgatccatgcagcatgttatctttgtacctggtaaggagtgaaatggcttccaattttacggactggttgcttttcattcatatcttcttgccatccctgtctcatgggtgagcacatttcctggatttaaaatgtatgggacagcctgtgagaattacagattccagggaaggggcccttttggcacggggggtctgatggtcagagctaatcaggtgtggaagaagctgcctggagaggatccccatctgcatggaatgcccccttcgtggggatggctggcacagctcacacacggaggcactacttcagtcctcccattaccaaactccagggcacacgtgccactgtgtcttgcccacaaacatgcacacagagtatcgatctgtctgatgtttcagggacccagccatgtcatggagggtacatgggcaggtaccatctctgcctggtacatgggcaggggatagatgtgtttccatgggtctccttcacatagaattgtcacctgaacgagaagcccttatccagaagcccagtgcaactcccatctcacaggccaccagcaagttgctcacatccagacaggagacgctagtcctacaggtgcagtgggaggatctgcagatgactacagctcttggcccttccatacagcacatgacaggaagctaggagggttgcagctggctgttgccattccactcagggttgaggggacaagcccacacaggtaccagaagttcaggggtcccatgtggacttcaggccttcggtctgggaccccagggagggtgctctgacagtccgccgaaatggccagcaggcaggcatcctcccaggtggcagtgagaaagggccctgcacagtcagcgttcctgagaatgcgattcctactagaacgaggctgtttcccaggctgcctcctgcttcacccaggactcagaccacaactagactagggaagaacttgttctccacggatgagcctgaccaagttctgggcccactctcccatcctcctgctgggtcacacggatgaggcctgtacactctgggcctcagactccacaccaagaagagtcaggggggctcactctaagccccgccagctcgcaccatctgatggggcaggggcaggggaaggacagggccagcattgagtaggcctgagttgatggcaaagtgtaggcctttgccctgtctcgcccccttgcttctggggtttgcttcgcctttctgagagcacagcaatgcctactcatcctgcccaaaaccctgctccaacctagctgtgtgacctttaggccttgggatagcacacagcaaatgtctgccaccccagtactgccactggcttgggaggccagaccacagaccacactagtgtcacctggcccgtcccacctgttccaagctgggggaggagtatgctcacttgggcttatcagcagagccagggtaccccaacccctgactaggatattgtggatacctatgcccagagcccctccactgccaagtttccacaattgttttgaaataattcccaacagatacccccaccctcacccagtgttgagtctcactcccgtcacggaaatgacagctcccagccctgggcaatgtgctcctgcaaggacagctgtggtgactagaatggcagcttggctactagcacttttcacatgagcgtggctgccctcaggcccaggctgcacagagcatggccgctggatcaagtgtgggtcccagttggatgacaaacccatgttcaaggctgggaagtcctactcggccccacttctacccaggaccagtagctttcaattgtaaatgtgcatcccctgtgatacactatgatgcacaagcagcccctgctcacccctaaagagcagcacaagtaactcagagccactgtcccctctggccagaggccctggtttgtgtctgcccagtgaccagcctgaagatagaggcaacccaatccaggtccatgcaggtctccgtgatgcggagcatgcccagcttaccatcctgatgcagaggcaaggacaacactgggccctgacttgctaagatgggagcaagagcttagggctaaaactcagcagtcccagctctgggggacaaggacccacaaagtgatgcaagatatcctgagttgggtgtgacaagtacaccttgacacacaaactgcacagggaggggaggaatctgagccagcttcctccacaaagcacagaagtctgccaaaagcccaggctggatagggagcatcacactgttgggaaatgtgcaattttcactcagccagcatcactaccagctccgggcttctctcctctggcctcccaccttgcagctttgagatcccaggcctctcagggctctggctgagggctgtgagccagaggctgaggtagccaggtctgccttgggctgtcactcagggctgagctctgctgaaggatctgggaggtcagtaggcacctgtgtccacccagctgtccatacagatccctgcctgcacaagagctgctgcagcatttcaatagggccatcccaggcaccctaggacttgagaccagcctcctctgtatggtcccttccctggtgcacctaccacagcccactctgatgaccccctgtcaaggaggtgtgactgagaaaggaaggggcagagatcccttctccattcctctcaggcccctgtaaaaattgggacctgtccttgccagccaggtctcagggagctcagggttcagtgttggaatgggtctgggcccagatttcaagccagtaaccagcaaatcatggggagactgagaagaggagccccttagcaggcctaaccacacccctaagccacccagcctggcccccctcctctgccccaactggctccaggccaaactctggttcctgaggagcctcaaaggctggacttggggtgtcccgcggaaatcctggtgggatggaaaatccccagcagttgtgaggctgcacttctcccacccgctgtgggtcagccaggccgctgcttcctgcttccctttgatgtctcctcgtgcgagggaggggtcagcacccctctaggcttgggcaggcacacactccactcagctgcagccatggagttggtgcttctagggcctgggtatgctggagtcaggcaggggacctggtgggggtggggatacaggctgaggtggagagaccccacgcagctccctaggcctctgcagacagctcccaagcaagggggcaggaggggctgcactgagcccaccaaaggttgtagccactcatacagggctgtttgatctgagagggaggcgccatgacctctgtttagacaaggaaaatgaagactctggaaaatctaagcacgtcacacacacagcttccatgggggtcttcctctcgtgtctggggaacttccccgtagaggtttcaataactgccatcctttgctgatcctctgtgtaggcactgggccccagcccctgcctgtgccatcactatttcacaggagaacaccacactgaggctctgcctctggttgccctgctctgggtgatgaggtagaggtcacacagccaggccagtggccctagtgtcaaggttccacaccacagcctcatagcagccagtgctcgctcactgaggccaggcactcatcttgtgctgtgcctgggtgagctctggacctgcctcctaaacatagggctgcctgcttcgttcatttccacacaccacgtgcctaggcccagctggggctggcatacaaattgggtggcccggctctgagctgctgctggttactgtggcagtttccacctataccacacctatatacttgccctcccccacacacagcccacctggcccatcccacaaagagagatggcactccaggtggagagggctgggccagaggtcatgcagcaaggtcaggttggaagctgaggtggggctagggccaccccacacaggcctgtctcacaggctgtcacccactgggcctagggctctgagagtaggggtctgatctggagagcaggggagcctgcaggtccctgggttggaatcctggagccctgggctgcagggttttgaggggcagttacctcctcctccccggtggcacatccggcctggaagttgggtagtctggcccaaggcctgccctggtgtgaaagcctgagaccctaaggagagctacaggtggctcaagggcctgctcctcctccttttctgtgcaaacagctcagcttgctgactttgatgcagtggtttaggccaagctttgaagtcagcccttggaggacgttcctatcagcctttgcacagatatctcccactccaaccctaagactcaatgccacctcaggactgcccctatccgcagagcttgaggcctttaggtcagccttgggaagaggtgcttgagtggggtggaagaagcccactcttgggaaatggggagcataggggaggaggaagacactgccttggaatgacactcccagagacctctgctctgcctacctgcattctgctgaaggttttgggtcaccttgttttatggtccctgtcccagcatgaagcttgcacaggaagaacagaatgaatgatgtggaaatctgttagcagtggtgtcttctagattctcaaggatccgggtattttaggaacaaaacaagccagcaggtgcagaggtcacaagcctcctgagagggccagggcagagtgagtagctgcaggggcagctgtcctttgcacctgggcctagagtgccagagacttagtctcatttgtttacaggagactgatgggttcctgagcagcctaggaggggaggggaagcactgcgttctcagtgtggtgcttggccctcccaggtgcctggttgtggcctgccacttagcacccacccctgcctatccagccccatccctggggaaggttcccacctgctccaacttctggtactcccaggctgcctcacccaacgatgacagtgactagcctcagagcctggctgcttggaagacctttgcccaagcagagaactgttgaggaaggtgagccttccgagggccagccctgcctctcctcccctctcctagcctgcttctgtctgggctgaaggcacagcagggacaatcgctcttccggggttagaactgggggagcagggacaaaaagcgggcagccctccccagcatgacaggatgtggaaggctggtctctccagagactgggctaaactctgctgtgtcaagtgcctggtgacctcaagcaagtcattccatgtggctgagctgctccttgctgcatctgcacatatgtgtagtgtcttcctccctgtaggattgtcacaaggattaaatgatgtcaagtctgaggctgccctgcagctgctgtttccactacttggcatggaacatgtgccagaccaaaagagctatctctctccctgcgaaaggctggggtcctgggagctagagctgggttaagataagagcagagactgggtcctgggaacagccactgggcccagtcgggggggtctcagcacctatcacaaagaaagtgccactgggcctagggaaggacaagaagtaacatgtcaaagatgggacagaacccacctcctggcagggagtggggcacacatatgtgcatgttcatatatgtgtcagaatgcgtatttgtcagtgtatgtgtgtcagtgcacataggtataggggctgtctctcagaattcctgagggctttccatttgatcccagtggttgaagatggagtatgatcccaaatcccttaggtggatgtggcctggcagggggtcagcaggagggaggtccctgtctccttggcttccagcttccaggctctggcactcccactgttaggaacaggtacctttagggacacaggagtgtaagccactgtttccgtctgggttttgtcatgtgtaggtcccagcggctttaagccaacctgaaaggttcatttgggagtcacgggtatgtgtcaacaaaagcccaccagaccatcaatgaagtgggcaaaagctctgggtgaactcttggctcaggtatcaggatatgctgggtgagggaaataatggaggcacctttgttctagatgcctgcagattcctgacaacagtaggggtggaggctgtgcagacctggtgcagagtctgtgctggcctctggcctctcacagccttgggaggggtgctcagagctcagctgtgtttaaaaattagcaagtggaggagttagaggatctgcagttaaccccttgagtctcggaaggctgtttgagccactaatcaggaaggagagctgacaagaaaaaggcgatgtctcacccctgagctacaatccactgcacttacagtgaccacccatcctgacatcttgggctcaggcctctgggtctgggcatagaagcccaggaactgctgtctgtggggagtccactgaagctccctgcccccactgagtctctgatgttgacagcctctttgttttttcatctcagcctattcaaggccatttttcagcttgcttggctttgcattaaagttggggggatttctctatcctgaggttatgaaatacctcagcaaggacgaggcctccctgagggagtcaacctagcttgttccctgcacgtactgtggggaggtcctctttaccgccacagttccaagggtgaaacagagaaccaggtggggaaggggtctctccccatctgtccaggggagaggcagcccacagggagccacacaggcaggggacattccactagggccatttgcaggccagtggccatccactgccagcaatcagagaatcacaagcactggatccaatgtgacctctgccaggaccatgacccctaggtcctcttttccatccctccagttctcctggctttcttgccatctttctggctctatcctcagtctccttggcaggttttcccttctggcatggccactaaatgccagtgcctttctctatgcaaaccatttccctaagctgttccctcagcaccaagggcttccagaccacctgtgaggccctgaccccccaaatgtctctccaacccagccagacccacattccagtcacctgcccccacctcctctccacagcctccatcattttatagcccactctactgaaggcccctgtcctttcagtgtcacccatcctttcagtggcacaagtcagaagttctggggtcatttccgatacacccgcttcctcaccacctgcccatcacctcaagcccatcaccaagccaggcttacttcacccatccatagttctagaggttccctgcttccctccatccctattgccactgtcctgataggccaccatttctctgtactgcaggcatctcctaactggcattctcacatcccctgccccattccaatcaattatctactcagtggacagacatcctttcaaagtttagagacctgtgggtcttgcttaatcctgcagctgcctttctggtagttcagatgcttggcttctttccatcccaggtgctcacaggctccctaccaccagagggcccttggcctgcccctgccactttccccaagggagtttttcagaccccaggctagttccagtgggttcctgctatacacctgctgtgctcccaggcctcagcactcccctcagggtgcaaacggtccttcaacattagttagtctttctcccctttgtccactaaccctgggagggtaggcaggtccctgctcctatcaaatccctccctctgggccagggtctagtacctgctgagtgtttgacaaatatttcttgaatgactgcatccctaacatgaggcaatgatcattcccctgcctgttagacataattcactgcctgggaaggcactgtgctgtgtagatgcagcaagctggctaaaatcaactgtagcatggcctatgtcccaagcaggttgtcctgcccatacgctcaataatgaggcccactgaactctcctggtttccagaagcctcataagcaagcacgctcagtgaaggaacaggaagtcctttctggagcagggggagagaaaggcatccagttagccatagaggggaatggctccttactctttaagagtcatttgccccaagactactttctgtcaatcaccagatagccctcagtctacactctgtgatccactcatgaatatctggtctggctctgcgttccagtcagacccttttctgagaggaccacaagtcatagcccagggctacctgtacagctaccaggcttaacaactcagatgcacaccctccacaactgctcttagcacccacaggcctgggccctctctccctgccctgaagccaaccagaccctgggtgggggccgagtctggccaagcagcagtgtgtggagctgggcctgggcctaagctgggaataagcttgttttgccaggcgctggccccccatcgagtccccattctctaatgctaattgctacaattagcaggagaaaggccttttagatccatttcttctcctggctgaggcccgggctgctagggaggttgagcccaaggcttttcggaggagcagggattcttccataaatgaggccacatttaaattgcaaacaagagcttcgcccagccgtaggaaaggctctgggagaaaggcttttagttccgcagacagagcagccagagactgggtgcgctccagcctcatgggccttcctggctggtgtgactggaaccctgggttatacaggctcctgccagtaacctggacatgctggggccggccagttcagaggagcatggcacaggctgataaaggcaccggaaggaaaggcagtattagaggccaccccttgccctcccatccaggcctgctctgagggaaaccctactcgtcctcctcctggagtgtactgcaaacctggatccggtatccgctgagaaccactcattcatcagtctgcactaactggagaaggtgagcaggcccagcccggcctctctaggccacctccaacttggtcaagccacaggtgcccatgccatagatggctgagggacggcagctgacacgtagttccaactaaacctctgggtggcagcccataggttgtgggactggaagtgcttgccaaacaaattatactgctgaccagggaagagggtactctgattggccaggcctgggccagggtctttctcaccgaggtggtgaggctataggtgttagatgtggcaggatgcaagccagggcctgctgcctttaaagagccacagcagagacaccatcccagtcccaagagctgttctaaggaagtggttgtcatctgcggtgccccccaggggacatatggcaatgtctggagatatttttggctatcatgactatgggagaattactaatatcaactaggtagagaccaggcagggtgctaaacatcttacaatataaatgacagcccctcacaacaaagatacatcctgtcccaagcattaccagtgtggctggctaagaaaccctggttgcaaggggtcagattttgacatgctatttgctttctcactgagttgtgaaaatggaggcacactttcctggcctggcctcttccttcgttcaataaatgaatgaaaccattcaacagaaatctgtgacacacccaccatgtgcggaccctatacggaagacagatatgctctcttggggcctctcttccggtggaagagataggcagccaacaaataagtagatgtctaaggaactagaaaagcgtagcctgtgctttgcagagactcgaaaggtagtcgtcagctagtgagtgactgaaggggatgacagatatggcaggtcagagcaaaatttcctgtgagatttaaataagaagaaggaattgtcaagggaagatcaccagaaaagacaagccaggcagaggtggtgaaggccttggggcaggagggatacttggcagatttaacaaagaagaagaaggctggcagagccaaagctcagtgagggaggacagtggtcagagaggtaagcagggcagatcttgtaaaaacctgatggaatttgaattttatttcctagaaatagaagccactagagggtatctggcaggagagtcatggaggcacattcattcgttggttcttggcttttgggactctgcacagagttgatcacagccctcagcctatgaaacactgtcaccctgtaagggtctgcataaagtcaccgctctcttcctctccatgcttttccacttcatctctagcctctatccttgctctcctccctacacaaacagcttctccagggtaatttatttatatcattgtgtgtgtgtgtgtgcactcacgagcactccctagtactgcgtgtctgggtggtgtgtaattttaatttaaatacacagtcatgtactgaggccctctttctgtttggcatttgtgtcactcagcactgtgtttccacgcgtctctatcttgtgaagtgtacatctagtcccctgctcctaaccacagtgaccagctccaactgcccacccctatgggccatgctgccctgagcatgcacacacacagcctctcgttgttctgggtgagaactgctccagcatgtttacttaggagggaaactgctgggccacaggtataaaatattttatttgaggaagaagtgttggccagctcttcagaacgtctgtgcctgtctccgtccccacctgcagcacacagggaggcttgttccttgccttctgccaacacttggccttatcctactttctaatgcttctcctatgaagaatagctgttgctttcatttacatttctctgataactgattagcttgggcaaattttcatctgtttgttaaccctcctgcaaactggcaatcttcctacctttttcttaatgatttgtggtgctttctggtatattttagctgttgttccctcctcagctttaattgtttcaaatatcttgtaatgagtcatggcaaagttacattcatgagtgtaaaagtgaaaaacgcaaattgtttccttagtattattatgaaaacagtcttgacccttgccatgatggatttatttaacagaaatccttaatccataatcattaatgcattcaagttcatacattttagtcttgaggtttgtgctttctggatcctgtttaagaaccccacggccaccctggccctggagattattcattttttctcctattaaacaaatggcaactaccttttgctttcaaatatttagtccatttggagtctacttttcctaggggctcagttaggaatccatattcctattcctccattttagggctggctttccaacatcatcttctgaacagtccccactgatatgtggtgccacctttatcacatgtccccttcctctagacttggagttacctctgagctctcttctgggcctctgtcaccacaccgctctgattgctgaagttggcgtgtgccctggtatctgccagcagaagtcctctgctctccttttcaaaagttcagttggcatttacaaatatttttcttccacatacattttagaatatgtttgttaaattactcaagccctccaactggaagtttgagtggagtcctgttgaacttaacagatttggaaaatcctgacgtcattctaatgccaagttgccctgttcaagaaaataaaatgtctctgcatatggaaagatctccctctatatcctccaatagagttttaaaattttttccataaaagtcgtcgtctttgttaattcctagactggtataaattttgctgctattctgattgctgtcctaatctctattatgcttttttttagtcagttgctattggcataaagaaatgtggtttgtttttgttttttgttttgagtacactgatcttatatccaaaacctctctgaaatctgaaatctctctttagttgttaagttccttaattttttttttccatgtagcccagtaattttcaaagtgtagtctggggattccagagagccccccagaccctttcaggaaaggtcaaaaacattttcataataatactcgacattatttgccttttctttcattctcacaaagataaagagttttccagaggcagcacaccatgaccccagtggaatatgtgcttgtatagttctgctttaaacatttcttagttttaacttctaagatggtaactatcaacagatagaatctctatcaagaaaagccctttgggggtttcaataacttttaagaatacaacaagtcgtaacaccaaaatgtttgagaatctttatggagaccatcaaccctatgagctacactaagttttatcacttcctacctgatcctcacatccccatttctttttcttgtattagggtatggccaggatgacatccttggcctactccttatcttaaagagaatgatacacttttaatttctctatcaagtttactgaaaagttaagttttggtttataacttgtatcaagttgaagaagttcctctctagtcctggcttgctaagtggtgtactccactaccccaaaatcacacataggcgttaaactttatcacatcatttttttctgcctctattgagggaaccatatggtttttctcctgtagcctcttaatgtgaattacatggataaagtttctgatattggatcatctttgcattcctaagagcaatcccacttgtttaagaattgttgtttaatacatattattggattcagttagctagcattgtacaaggaacttctgcatctacattcataagggaaattctttatagttttcttgtgctttctatctgaatttggacatgctctgattcgcaattttaaaaaatccctctagctggagcataaatcctgaaacagacccacttttctcctcagcatgttaggaaacacattaaaatacacccataatcaagcaactcaatccttaaatttttctcctactgagtatctggaaaacaggtgcagaaatggatcatttgagacaccatagaaatctggttaatcctgcctgcctgctttccttcaagtactgactgagtaaggctgtgtatcaggctcttggctgggtacagagcaggcagcagaaaacaaaacagagttcctcgttgggagcttttggtctagcaaaaggggcaccacagtaaagaaagaactggtaaatgcacatcaaatgtggatattatcaggaaagtttttatactttgtgataatctaagacagaactattctacctggatgaattattctctttcataaccagaacagtgctgtgggaaggcactcttactctcaattttatataaaaggctatttgacctgctcagggaccacagtggggtactgggatctgaacatagtggtggcccttcaagcctactacccagactgagacctgcatctgatcaactctcatctccaatatgaccaagagacttctaccactacctctcacctggcaggtgatcaccacccccaactcagactgcaacctttacttcgccccctaattcctgactcagaatccccacctagaggcagaacttcgacttcaattcctgactcccataccccactgagacctctaaccccaatcccaatctcttaactcagagccccccattcagaacctctacccaaagacagactccagaccctgactccagtcgccaactcggacctcccttggatctcaactcagagccatgatgcagactccagaccgggattcaggtccccaactcagactcccgatcctctgtccctaatgaggccctacctaaaaccaccatgcggactccagacccggactgactgggaccccaactactcagatcccaactcaggcaaactcccagccaggatgtggaccctagacccgaattctgatcccaactaggatacctaactcagaaccacaacggggattcccacctccgatcctaattcgggccctgactcagaaccactaagtggatttccgactccggtcccaattcgggctttgactcaaaaccacaacatggattcccaacttccatcccaatagcgcggactcagaaccacgatgcggattccagactccaatcccaattcagcccactctgaaccaccatgagaactatagacccggaatccgatccttgggacgcggccaggaactcggacctcgaccctggccacgctgtccataaggtgcagatgggagcgcactgcccaggccaggctgcactgctgacgcctgtgatctgggacggccgcggggcacacagctcacctcagcaacgccagtgatcacccgtcccgcgccgtccgcccaggtccgtgctgaccgtgttcaaaccctcccagagagatggggagggccgcgctgaggagagtctgggagaaccgcactgaggagccgccgggagagtgccgcgctgaggagcccccggggagagtgccgcgctgaggagcccccaggagagtgccgcgctgaggaggcccagggaggaccgcgcggaggagaaccatgctgaggagcccccggggagaacagaaccgcggcgagaggcccccggagagaaccgcgccgaagaacccccggggacaaccgcgccgaagaacccccggggagaaccgcgccgaaaagccccgggtgccccgaggagaacggcgccgaggagtccccggggagaactgcgccgaggagcccccagaagagcgccgcgctgaggagccccgaggagaaccgcgccgaggggcgcgccggggagaaccacgatgactgacgcaccgaggaggaccgcgctgaggggcgcaccgggagaatcgtgctgaggagccccggggaggaccacgctgagaggcaccccggcagaatcgcgctgaggggcgccctggcaggatcttgctgaggagctccctggaggtccgtgctgaggcgacgcggcgaccgttctgcctggagactgcggcagcgctccgactgcccccgccgctgccgacgtggcgaccgccccccacctgctgattgggcggcagcaggggaaggcttgcggcgggctgctgcacggattggctgggtgcggaaagtgatgtgccgtgtcctgtcattggccgaaagagtctcgttttgatgccacccgggctcagattggcccagcgggtccagcgccgcatgaggcactggctgggtgtgaggtggcgcgagccgccgccctccctgcccccacccgtcgtccctgagcaccaccgggggccggggccagcgccagcctcagcgttggcatcgccggggtgagctggagacacgggccagttctctgcgtgatgtgttcaccaccccggggtgaccgcgtgaggacagcggccgcaccccgacactgctgtgggccctcggtgtggaggcctgtgggcgtccaggccacgcccgagaccagcccctccgccggcgccgctgcagcgaccctcgaacccgggcaaggtctccaccgccgtggcaccgggtgcgggaggcgttttcccccctcccagcgggtccatgcaggggatcgggatgttctgaagcccccactgctgtgcctggaacacccgtgtctgccgctcacccctgaggacttgggacctcagggggtgagtggcaggggtggccgggacatgccaggccacccacctggcaaagggcagcgccgagggcgccccgcgcctgccagcgcccggccgggcccgccctgcccacctcccatcccccatccgggcgtgacacttgaccgcgtctgccggcccctccccttgtccgtcccctccgcgccgctggcgcgcgccttctgaatgccaagcattgccataaactccggggacaaaagcctgggtcacaaaagccccctctagaagttcacaccctgaggcttccctggcaaggctgggggccgtttggcccttccatgtggactgcaaaaacagtgttggaatgcaggactctgggtatgttctcgaaagttgttacaaccccaacccagggttgacctcaaacacaggaggaagggggaggctggagccagccaagcgagccagccgtccccccaccaaggcacgcaaggaggccattcatcttcactgcctctgccgaaaatatacgtctacgggagagccaggaatctctctccaagggtgaccgggttgggggttttgttgttcttcagcccagaagagaaagagaaaatggtgtcattttttcaggcagcaagtgattcctttcaggccttcagcaacgacgcccagatgagtccactccctgcctcctgctcagcccacaggcaatctgggcacaagtgacacatcccctgggcgcctgtcccttcgcactggcccagggagttcatgtgtctgatcagagggcgcagtccaccctcactatctagctgggaagtttttgtcatctgcctgtccgagaggcagctgtgcaaccagtgccatcactcagagccagtgctcaggtgcaccccagactcagggtttcacgctataatgtcactgtcttgaaattcttgatagttactatctttgaacttgtgttttagaagtgaagtctgaggggaaaatggagcttggaacttcagctcccaagtggctttcccaccttcctgcctcctcaggacagattatcagctgcctgtctgcctgcttcctctgtgcccagcctctctcttgacatccaaaggatcacaactcccactcagtgaccactattattctctgcccctgaccaaaaagagcagggcagggctggagtcctgaccctggcctggactctgcaatgcagagatacctgcaagtctcatttccccgcctgtaggatggaggtgatgctgacagcctcttggagccattgagataggaaacgagagagattatgtgagaagacagggtcaggaatgttgagttgagggtggcctcaggcccctgtcctgctcctttttgctgcttggggtgcagctcaattccagcctcactgtggcccccaggcctcctctggccttcctcagccttcctcaggaggccagaatcctcccctgatcaccctccctgcatgtccatttctacctccccaggaggtcaggggagcaggatcccaggtcttcagagtcatttcacagatttcaccagaataaaagtcccactcatgtggggtttacattctggtgggaaagacagattttcgaaacgtggccatttttctttgggcctttgttagctgcatcagatggaggaggtagcctggtggactccttcagtcctcgctcttggacacagagctgtctcccagcctttgttgttgtgttctccaaggatgtcgaacacaggctgaaaagctccctaaatcaatttcacttaaaatggtgtccaccctcctactaaagagtgacaaagggtgttggttaggatttttatcttgaaaactgatttgtaaagtcatgaaaattgagcttatttggtcttacacttaacaaaactgtgggttctaattgtgggcctggatggggacatatcttacaagtagttgattcatttatatagattttcatgttctgggcttgcctccaccctctacctaaccctggaacctcagaccccaagctcctgggcacttggatttttccctgacaaattccccgcctgtgatattccatgggcacctcaccttgtgtgcttgtgtgaggtctccttgagtactcttagcagtggggttgccaggccaaggagcctgtcactattgtttgtgaccagctcaccagacgtggtcaggaaggacagttctgtgtcctatgtcctctgctcctcaccccctcgccacacacggggtgccgtcaatcagccagcgccgcctgccagcccagcgcacctgttgtgtgcccccactcccgcctcctctagtcctttgggggaagagtggagaggaaaacaggccgagactgagaggggtttgttgtctcgtcgggcgacaagagacacgtgggaattggctagagaagcatgtgaggctgggcggactccaggccagccccagaggcagatgggggctgccaggcaggctgggaggtgagcccagggctggccttgggcaccatggcagaattctgggagggggctgcagtcacggccagctccctttctgaattgttctgtgggttgtggaaggctttgaaatttggcgcctgcaccttgtcaccttcttgggactcaaggctgcaggggtgggtgtgagacagagagcctgggcacctggtggccactccctgagctccccacgtgacagagggcaggtcccattctccttttgtgtctggtttgcctcatctgtacatggtaggggctgagctagcgttccttgcactccctccagctttactctttggggttcaaaaggttcccttgcaagcctgtgcacccgagagcacgcacgcacacacgcactcacagctgaagagaattaggctcaaaacgtccactcggcttttctcttgattccaaggtatttagagtgggggtgggggattaggggaggaagttgctgagctaattcttttgcatttgccagcacagaagtgcagatggggcccagagccccggcggtgtcccaggggaaacaccagtcctcttctgcagtgcaaggcaggagaaagaactgctgtgggagcccctcacccaagcagcaggatgtgtggcaggccctggccaaggagttctgtgggcctcaattctctccctaccctgcccccaccctcggagtctaagggtggaaccatcttcagacccagccaggttcccaagttgctgcttccctcggaagctgagaggcccagggccacgtggcagcctccgcagtccatctgaagaaaggccccaccccacgctgctctcaggagtggacaggaacgtgggggagtgggggtggttaggacctcagggttatccctgagtggctgatgcattgccaggaagcctgctcttaaggtcagcccttgcagttggcagtctgtggcccctcctcggtccccttcagtgaggctttttgcatgcattggtccacacacccaccactgcagctgtcctgggtaagggctctgtgatcctgcaacgcccaccttcttccttcactggtcataggtttctgctgaccctgcagcccatgtccttgttccagaatcttccgcctcctgtggcctgtgtgtcgcctgcacctgcattccactggggcttcccttccaacttgatggtttcaggtacatgggcctgttgtcaactctgttcccactgagcccatgagacggctattcctttgagacatgtttacttgacttcctgccccaggtctctgctgtacccacaggtggcatggactcatgtccccacccaaatcacatccccaccaggatgggcaggctctgggtccttttgggccttgtaggctgtcgtcagaggggaggcacagtggggagtctctaggaggttttgggcaaggcagtgccaaggatcagatctcccttctagaaaggtcactctggctgctgaacagagagagaactgaagagaggcagcagggtgagggggaagactacgggggacttgccgtcacccagtgagagagatgggagggttggagaaagcgagcatctgtggaggtgtgagaagtgccaggctgggctccctcaggcggcaactttgtctagacttctggctgaggacagggaggagcttaaggtagccctcagcatccaacaggggtagcagcctagtgcatgtatgaccacgagcgagcccaagggaaggacgggtttggagggtttctgaagatctggcttggatatagtggggtcagaccctatccctccacccagctgcagtgacaactctgtggctctggggcactgtcaccctgtggcatggcctgtttgtggtgtccattgccgtcttagctacccaaggcccagggagaggcacacggctcaggctgacagagtgtgacagatgcaggtcctgctccctcagggaatcccccattccaggacagtctcagcccccatgcaagagcagcctcagcatgggctgctcggggaatgccctcagacaacagtgctgtgttagggtcactcccagcctgtcctcacaggcagatttgcgttcctgcatttggggtcagtgataacgtgaggccagacgggtggggggtctggagttcaggcggtctccatgagtggcagcacggggtgtgggccagttcccattgggagggcagctgtgctgtgtgtgtatatgtttgggcattgctcagccaagccttgattagccgaacccaactctcccagagcccccacttcgacgcgggttaactcagcagctgtctcctgagcacctgcttggggcctggttgggtgccaggcacgggggggtgggaaaatgaagtgaactgggcctgccagacccattgcctgcagggccttttctaccaccaccttccagaggcagcttcctcccacaaagcatcccaagctcggggtgtgtgccccccttcctgtgcaggcctgccacttccacagctgccccccagccaagaacaatcccctcagcctgccagggaaaagtgggcccaggcctttgaggacattgccacagccagggccaacctgggaagttgtttctgattatctcttgagtcctgggagaggtgttaacaaaaagccccatccctgtcgctctggtggttatagtttgttttacgcattaaaaggccctggatcggtatttgtagtgagaacagatatttgcagagagcctactccattcccagctctgtacttgtagagggtgaggctgctgaaatgaaacccaccaggcctctggtgagcagtgggtgcagagtcattggcagtaaaggtccttagagaacctgaagagaatattctaatcaagctaggcaggctcagaagatggatgtaatttggaggaaaaagacaagaatgggaaagaaagggaaacctacctggggtaccgtgtggctgtggtggttttagtatgtgtctacaaggcctttgacaatccgttcttccggaagtggcacttaattcccctctaattaagttttggctggactgtgatttgcttctttcaaataaaatatggaagaagtgacagagcatgacttccaagactaggccttgcagcctccctgccctctcactgggatcactgattttgggggaagccagccaccatggtgtgaggacactagcagccctctggagaggtcctgtggtgaggaactgaggcctcctataaatggcctcctgtatgagcttgggagtggatcctccagccccagtcaaacctctgatgagacagcagccctggtctacaccttgactgcagcctcacaggagatcagaaccacccagccaagccacccccagatccctcgcccacagaaaccatgtgggatgataaatgtgggctgctttaggaatgaagctgtagggtgacttgtcacacagcaaaggccagctgacagagccacccactctcaccaggcttagtctgacccttgtcaggggcagcaaagtgggctcagcctacctgttggcttttactgatggttggtggctcccaggagaaagagtactgtgcccaggtagcatgcccaccccaggcatacatagcatgtctttgctcttgcagagtttgaactctgcccaccagaccagtggctcttaacctaggctcctcgtgagaaccactccccggtgcaggtcccactcccagaaaggagagcggttttgactcctgcagtctctaaggcagcagagagctgtggcattttgggtggagtgggtggagagggtgcgtgatgggtgggagaaactgacagttggaatgtgatttaggaaatgtaacgggtgaccttttctccccaagagaacaccaaatccatttccttgggacatggataaggctaagggcagcacccacaaggaccaggagcggggttctcaacagccacttctgtcccaaatttgttttctatgcccaggaatgtcaaagggccctcttggggtcagccacagagaagggggagcaggtgtgatggggtggtgatgggatgctgtaggtggatgagaagtagcaccaaagctcactactgtttttctcttatccctgggtcttggggacaggcctgtgccagaagcagggattgcttctgctgtaacgtccactggaataaaaagcagacattgcagtgttgagaaattcctttagccctcaggaggcaagttacagaacaggacagaactgccctagtcaggccctgcctgggcacagagctgccaccactcttccaagagccctcccttttggggactgtgcccccaccccacccccaggcagcccctgcctccaaccttactcctagctggtgttctgggccgtcagttcataggtccagctctgagacctgccaggctctcagagcagcctggacccaggagagcgataaatggatgtgcactggcacactccaagcagggaggctttgtttatctcccaattagtcctgtagcacttagtatgtcaggcatggttctgagggcttcatccacactaccacccactgtagagatgggaaaactgaggcatagcaaggtcaagggattgggcaggccttaggatgtagaagctactagagctgggctgcacctgggtatcctggagccagggtctatccctccccctctgccacacggccttggtgtgagggacacagcccctgtttgcagaggcagctcctttcatggagcatgggggacagggcaggtgtgccttggcccacatttggcttcttgagcgccgaacctgcatgtgccaccccccagagttcctgtgtgtggccgggtgaatgtgcacaggtcgaggaggtggtgtgggcagccaacctcccaaagcaccaggcccctcagggctgttcccctgtttcccaagatttcccaaacagatggccaagatcgggggcacccaggagaccacgctcatgaattgttccacttgaacacaacattgttttttatggaactgggctggggagtcctctgtgactctttcctcagtagggagagagctcctgaacccaccgtgcacacttcttcagcagccgctttggagacttgactttgacactcttctcaacaggatccctttcctcactggtgtctgcggcccgggccgctggcatggctgagcggaacttggcaaagcagtgaattgggagctcacttaggcacgtggtcctgaggctccttgctggcgtttctgttttgctccctgctcctttcttttctttgtaacttctcttcagggcacccacagcccccgaggagggtggggctgaggaggctggaggtggagcccaggcttatccccctggtgggccaggcaggcagcaaagggaccaaccccaagagggtcggtgcggagacccctggggtgcacagggtgggcagtgaccagaagactcaccccagggcctctaattttgacccttgatctgggtctaagcacctctgagcaagaggtgagggtttcaggcagcctcagctcttaggaggcagaagatacagtttatacgcgggttgcggggggcggtccatttccatctccctgttctctccccaggccaatggccagggctaaagccctccttgggacatgtcaatagcagcaaacattttaaagatgtgacatgttcgaagcctggcaacaggggcagctccagctgtgcgagaacatggctggatttacgtctgcggcaaagcacccggtcacctttctctgcttggagtgcaatctttttttggaagccctgctggaaaatctgaatcttgtgagccatcagctgtttataatcagagaagcatatgtttaaaagagctgaggggccttataaactccgtgtgcaaattacctttggggctgcctgctccaccgcccctccctgaggctgccatcactggcgagcggctgagtgtgctgcacagaattcgctgtaaccctgttgtggcacggggtctgtttagctttagtcacgtcagcttggccctggagcgtgggagcctccatctctcctgcacggcttccaggccccccccacccccaccccccagccccagctgcagaggacttctggctccctgttcctgggctttcagcatgagaaatatcaaacctgggaaccgtgcagcaagaagcgggcagaggctcagacgccaggacctgcgggggcttcctggaattgggagccactctcggtgtctgctctggtgctacggtcctgcagggctgttttttttttattttgtattttttggtgttcatttttgtttttgtaacagctttattaagataaaattcacataccatacaattcacccatttaaagtgtacgattcaacggtttttagtacgttcagagttgcgcaaccatcacactatctagttccagaacattttcagtgcccctaaaagcaaccctgcattctttagccgtcactccccacttcccttctctcattccccagccccagtcagccacggctctgctttctatctccacgggtttgcctgttctgaacatttcacatagctggaatcacacactaagcagacttttgtggctgacttctttcacttagcctaaggttttcgaggttcattcatgctgtagcatgtatcagtgtttcattcctttttagggccaaataatatgccattttatggatattatcacattttatttatccattcattcattgaacacttgggccatttttactttttagctattagtgaataatactgccaggaacatttgggtacgagtttttattgtggacatagattttcatttttcttgagtattcacagaggagtagaaacgctgggtcatatggtgactccatatttaaccttttgaggatctgccagactgttttccaatgtggcagcaccattttgcattcccaccagtagtgtatgtgagttcctatctctccacattctcaccaacacttgttactgtctgccgttttcattttagccatcttagtgggtgtgaagtgatatctcctagtggttttgatttgcatttccccgatgactaatgatgttgagcatcttattagccatttgtatctcttctttgaagaagtatgtattcaaattctttgcccaaattttaattgggttgtgtttttattatttagtagagttctttatagtctagatataagttttttatattctagattcaagttccttatcagatatattttcttcctttttgtgggttgtcttttcactttcttgatcatgtcctttgactcacaaaggtttttaattttgatgaagttcaatttatctgtttctttctttggatgcttatgtttttggtgtcataactaaataacaacatgtaatctgaggtcaaaaagatttacccctatattttcttccaagaattttatagttttggctcttacacttaggtctttcatccgctttcagttagtttaacatatggtgtgaggtaggggtctaactttattctttgtcatgtggatagacagttatcccaacaccatttgttgaaaagactcttctttcctcagtgaaggatgttgatacccttgtcaaaaatcagttgacagtaaatatgaaggtttatttctggattctcaattttattctattgatttgtttgtctatccttatgccagtactatatcgtcttgattgttatagctttgtagtgagttttaaaattggaaagtgggttttccaactttgtttttctttttcaagattattttggctattctgggtcccttgaatttccatatgaattttacaatcagcttgtcaatttctgcaaagaaaccatctgggataccaatagggattgcattgaatctgtaggtcaacttggggagtattgccatcttaacaatgtgttaagtcttccaatccaagagcatgtatttcattgtatttggatttttaaaaatttggttcaagaatatctcatagttttcagtatagtttttgcactactttgtaaatcctacagggttttgtgtgacagtgactggcagccatacttcctccccatgtactgggttctgcccatcctccagcccatctcccttggagtctctccccgactccagggctcatggcccctttcaggcccttggcttctggtaatgcttctttgtggtctcctgtcttgcgcactaattgttgcccaagtctttgcacatcctgcatcctgcctggagtgttctctctcctcccttttctgtgagccgtcatgaaacacctcctgtgggcttactgagccaccatcttatccaagtgctctgtggcagcttgtggaatcttctcaaccttgggtgtcgcctgcccagaacggggctctcggaggccagggtgactccactatcccaccaacctctgtaccccacggccatgcacaaggcacagggtcccacagagggtctgtgggtacaatggagctatttcccagtcagacctcacaatcggtaaactgtgcttaaactaagtgaggtatcttaaggctttaccaccagggaaatagaactttggcagcttacaaaggagttttatttttcaaatttcctttcaactcgagggtctcaaatccactcagcagacttaggagggagggtcctggcactgcttctgaggagggtgcctttgaggggaggcagagttggctcacgggaaaggctggccctgaggcatggcaggtggcaggtggctggggctgctcacctgctcacctgtgtccatccccttgggcagcacacagccaagtccttttggaccaaattggatcactgccaaatggtatgcccagccttgctgaatctctacccatctgtaaaaaggagaaatcgtttctgtgctccctgcctcccagagagccagggagaggccaggatccaaggaggtaacggctttctagccctttggaaacctgagtggggttttgtgcttgcatctcatttaagccatgaacacttgccggctctctattcatccacaccccctgcatttattgagtgccttctgggtgcccggccctctactagatgtgggagttaccgtgtgggatggactgacactggtgacccctgcctgggggaagcagactctagctgggcagcctggcctcaggagatcatcacaaccctcgctggggctggggtgcaaatggggcaggaacaggagtccggcctgggggatgttagactcaccagccatcccctggaaagctgtggggagactcagagcagagcccccagtaatcatagtgaggtatttagggatagagtggagatctcgcccacatattcccgaagccaccaggccagacaccgccccagctgaatgcatgctggcggcccaaatgttagacactcttctctcttaggtggtttgaggagacttaggggcttccatattccccttggaacatgaagaaggggctggctaaggcccccatccctgctcaggcctacaggagagccctgtggacactccagcctcagccttccttgccatccgcaaccacaccagtggctggaaagccagagtcccctggctcctgcactttttctgcacgggactccctcacagcctctgggttgggagcacacatggcatctcctagagagtttgggggctggacacagggaggaggcagcatgggaaatggaaggactgcagcccccgcctccctccaaggcagttgtcagagcaagatcagctccctggaagacacccgggttgtaaacagggtggggcaggggtcctggtaagtatgaggaaccagagacctggtaagtatgaggaaccaccccttggcatggggcacccagaaggcagcaggctaacgactccccatgaaattaacaactttgtgaagcatttggtatttgggggattttacattagggttaatgagcctctgaaatgagatcccggagaggggccaggaccatgcctgggatgtggcttccgtggactgagcagcctggagcccctacttgcttggtgtcccgagccagccggacctgcatcccgctcctcctccgctccctggaaacgttccctgaatcacattgttcactgcgcttctcaggccttctgggctcttcctctgctgctcgccataaaaactctccagtcatcttttccgctgtggtttttattgttttattttattattccagctatattacgttgggaagagctacagaaatggtttcttctcccccagattccagaacaagtcacagccattgtagattttgattaatcgccatccccattatttcttcactttctccagctgaatttttcccactgtgggaagggggtctggaggacaggcacccttgttggccgtggataggtttctgttctccctcgacccacccagcaagagaaaaaagtgagctgacattatgggtcggcccctgttctggaggccacagccacaggctctgcgggcctctggccgagctgggttgcaggagaagccaagtgccgggtgaaggcctggggaggaatctgggttctcttggctgctggtaagattatccattaaatccatattcctcactgtagagttcatggattcagaggatataccgtattctggccgtcttacattactgcaatattgcttccagatgggcaaacgcgcgctcggagcctggccctgcagacacgatggcccagcacgccgctcactgccgcgcctttgttctctgcttcctgctcggttcctgctaactcagggagctccaggtggctgccactcaggggtgtgtggggggcgccttggggcacccaggcctgcagccctcccccacacaggcagtctccacagagatagagcgccaaggatgcgggccaggactctttccgagcctctcctgttgctggggcctgctccctgaagggcacagtcctgggcaggcgcagtgcccaggctggagaggtcctgcgtctccatctcatccacaggataagtcaaatgggagcattccagcattccgcatctcatgggggggttgggcctcacctccctggcagcccactcacctcacatggcctgagccgcaaggtcagccccctcccaggcccgtgagaggcagcaggcactatgggcgagctgcctgctgggccacaggctctggtactctcctgggttggggctcccggggtagggctaagtgtggtggcagtggagtcagggcagctggacagcccctctgccatcagtgagaactgtcttctctctgcttcccctgtgcacttctgaatccccagggctgggcacagggctgtgacgccataggtgctctagatagatggaggagctcacagctgcagggagtgttgggtggacatatggggtgtggggggcgaggccaggcttcacagaggtggaatctcaaaggaggaagcggcatgccaggtggcggacatagcacctgcaaacgcctgggaggtgaaggcaccagctgtagccagcatcccagaaagggacacgaagcccttggggccggggtggtaggggtaggagagcatcttgagggtggctgcagcatcgtcgtcatctttccaatggtggcatcccttccccaagcaagggaatgatgcagacagaggtgcctttcagaaagaatggaggtcctggggacctgacttctgggtccctcaggacacatgctctccagctcgtcagtgttacctggatactctaatgggggcacaaagccaggggggagcctgcaggaggggcctagccagggccaggtgtcacacaagcagagctccagggtgcagctgggcagattgccggtggttggtgctggtgaggagtagcagggtggggtccggcggtaatgccactgatgatacttggcgaggatgaccgcaagtgtcttgacccaaacatgagatgcccctcacccatcctcccatgaacctcagcatgggcaccccatgccacccgctccatttacagccaaggagcctcagtagagacacagctagaaagtggccagctggggtttggtgctgagcctctgtctgactctctgctctctggagagctcaagggaacctgtaaagacctgcgggctgtgtcatggagggcccttaccccggaggagccaggaaggtggacagagcaggcaggagtggggcaggagggggctttgcagattacccagaccctttgttggccagtgtgggaatggggggaggccagggaggaccccctgcagcctggctcaggcaggggcatgtgtgaaggcccagggggaagagagcagccaggtagacttcgtttccagccggagtgtacctggggatgcctgtgcccaagccttcctcttccaccacccctgctggggtcccctgggacccatccttccaagcccctgccagccttggaacctgtgactccccaggtggtcaaacacagaaggacctcttgggggaaggggaaccagcaaagggggtatggggagccctctggggcaccctcatatcacaccctgtccctctggccacattccagctggccctgcctgtgagggttgaccagctggagcagccccgcatcccacatccccgcagccttgcgctggtctaaatgcctcccagcctcctgaggttgagggtggccacaccagccagagcttgggtgattgagtgggtagagggggtggccagagtgggaaccatggtgatgcaaaccataaacctgtcccccacgtcacctccaaaccctttgggctggcctcttggtgaggaatggccctgggagaggctgccctgcctttgacctctcatgcactgagagtaatgggcaagcgctgtctgcagagcactgaccccaccgccggggtcggagcccctattcctagcctcccttgagcgttttggttgccggatcctcattaatggctgtttgtatcacttaacaatttttcacttttggaggggtcgtgaataaccccaaagcaacatgtaccctctccgggccaggctcaagcggtcctctcactagggaaagaagtcagaaaaaagctccaagctgaagcgcccacacctaccctctgcatcagatgtgctgcggctctcaaggaaccctctagggcacagctttggggagtggagctgcgtggtcagctggccaagccacagtgggaaaaggtggcccattggccagaacacagtccccaagcctcctcagctaggctctcgaggaatggctgggtgtcctttctcagcagaaaagccttgtccccagcctccagggccaggctccagcttcccaggcgtgtgcttcccacccaggctcttgtgggttggcttgccaagcggtgttaggacacgcagcttcagttctgcagggcctggtggaattccattccctgcctcccagaaatcttatcttgagggccgctcagctacagtaggccccaagccccagagactccagattccccactacggaaggcagccgtgaaaggcacgggcagcgcggtgcttctccttcaggaggtggaactgggtggcccgcattgaacaggccaggagcactggtgttctggatccaaagcaaccatctcttcccacatttggagggagccgagggcaggcaggagccaggacccagtgcatcctgaatactgggtgactggcagacatcactctggcccaaggccaggcctgcagtaggagctctgtgcatatcccctatgtgagtacaggaacctcagtggtgcctgtggagctgttcagtgggccctgtattcgccagcacagccatggtcctgctgagtgacaaacagccccccagatgtcctgccctctggtgctgcttgtccaccatgaagtggccggggctctgctcagggacccaggtgctcttgcagacaacccaagtcttccttcctactcctggcagggcaggcaattccactgatggctgcagtgcgacacagactgggcctggcatggtgtccctcagaccccacggcttggtcgggtcacctgggccatttcaaaggctgttggggagcaggaatcacaagctggatgtcagcttgagggttaccccagagtgagagcctcgacagccaggccctcccaggcttctgtgatcgcagcccacacctctgcgcacagtatgccaatgttccccaaaatctacatactgagaaggtagacagcaaagccacagggagacttctgggtagcccaggtggaattcttcccttcctgtttcccagttttccacccttttccctggctttcttccagaaccttttaatgaaagtgcctctgccccaccagggcctggcttaggatgggtgagggagaggagctccgggaggtcacggccccacccaggaacgttcctgtcccaatcctcccatccccatattcaggaaagttccccaggcccgtatgaactggcttcttaattttgttttaaacacaagctttcagaagagcagaaacggaaagacagatggcaggaggtgccgcagggcagcactggggagcctgagatagagagcgggtagacaggaaagcagctcacagcggctggagagcagggagcacacgcctgtccaagaccttgggccagaggaaccccctctcccccgatggcccactcgccccagggcctccaggtttgagccccccggggtattagcccagcattttaggggctgccgtggtcatggagtaaagaccacacctggcatggcttccttggtttctgaaggctgcgaaagctgcgtctgtcgcagaagtgaaccttgttttgttttgttgatgggtgtagtctcagggcatgttcaatgtctgtggagctgcctcttctggaagagccgggttgacacccgcgtgccccgtcctggcttaaacactttgaggccctccctgccctcgggggagctgagagccccactgcagcccagaggccctcccctgacagctgccttcctctgctccgtccttccccacatccccctcacacaccttgtgcttgctctgggcttcaggggcctgagccccaggtagacccccacacttagggtgcctcaccacactccatccctagccccagactggcttccctgcatctggctgaccccctcctcacctgcctgtttccacctcagggcccctcctgaagccggaacttgatccccgcagcaccagcccctccccgtagcctcatggggcacagctctgaggatgtggatgagcagaggggaggacagggatgatgaaccccaggaattggcttccagtggatgcaaggctgactcgtacatgtcatggaggatagttcgggcatctgagctagctgaggctccttggagcacatgcatggcctggactgtccagaagtcgtctacgtgctttgtgtagacgcatgactccccagctggctccgtactagatgacctgggctagggccacttatatctgtcaggggaagggcagttgcagttaggaccacactaaaaggttaatgtccacgctggtgttgaccaagccctggaccctgctgtgccaggcactcccatcagcatccaggtgcccattttactacagggatctgagagctggctaggcaggcatcccgggtcattactgggcctgtaagggccttcatgtctgcaccctccctgccatgcaccttaaggtcaggaagtccattcaaatgcagattcctgggctattccaagagttactgaatccccaccctggggtgaaggcttggcgtctgccagggaccatagaccacagatactcatctacgcttgtgacccccctcccgcccctgagtgtgtgctggggcaggaggccctgtggcaagtggagccccaaccgcagagcaccatctccagccgtgtgctctcgggtgcagagctgacctcccaagtctcaggcttcttgtctctcattgggggtaacaatggctatgtacataagattaggagaacacacagaaggtggtgctggctaaagccattatcacaggctggtgcctatagtcccagcactttgggaggccaggcgttagagaccagcctgggcagtataacgagactctgtctctaccaaaaaaaaaaaaaaaagagccatacaaggtggtgcgtgcctgtggtcccagctgtttgggggctgagatgggaggatcgcctgagcctgggaggtcaagagtgcagtgagccatgatgactgtgattgacgtgttgaccaggcactcaaaaacaaacaaacaaacaaacaaaaaaaaaaaccattatcaccccctgcacacaaatcccagagttcagagaacacagatcaaaataagaagtcagagaatcctctccagctgaaaaccctcatttgttatcacccaaatgctgcctgctggctggcgagccttgctggtggtggaaggcccagcagtagcaaaggaaaccagggcaggacagtgtaggaagtcctgccctcggatcatttggggaaattggcacctgtgtttctcaccacacagtgttgggttggagaatgggcctgggtgcagagcttcggagccaaacaccgtgctggtttcagagaaacaaacagccctgatgtagctgtggcccttggaggtgtccgaatagtccatcattttcagtgacagaaagacggaaatggacacagatcaaacctgcatcacagatgtatagctaggtcagcgaaccactcaaaagaccccagggtctgaccccttgcacgcctgggcggaggtggagccgcttcaccatacatgcaaatgtagcaaactgcaaaatgtcccaaaacaagtcccttactgtccgtgtccctccatgccagctcactggaggggctcctgctgaaagaggtggggttcagttcccaaacccactggagggttgcaaggagacgcttctagtatgttagacagcacagtcttccaaatggactgtgggcatgatggatgtgtaaagaatcgagaagccaagtgcccttgccatttgttatctttaaaaagtatcggtgggctcatgggggcttgagtgtcctggcagctctcctcatccatcctatgtgtacactcaggcacgtactccctggctcagccgccttccggggcccggctacagtcaggcctccttcgtgctgagcatgtgctggccctgcctggggacagctgaaggccaggaggaagctgctggcctcaagaaggcctctcgaagcagaggcagccccctcgaagctcacctggcctctctctgtaaggggagagggacccagggctgaccagagcaagcagtgtgccattaacccctacctgtccagaactctgagctcctgtgggtccttctctgagtgtcctatgttgggggtgtcagcctgggtgtcaaggctgaagaggggagcctccttggccactgaaacggaaacagcattagccaccaccagccccttcccccttttgcagggcggctcccagaacctaggagtccatgctacctgtggggttcatagtgtgtccctctcagccaatgggaagtcgtgcccttggatcatttggggcaaatggtcctcgttttcttcattatatggtgttgagttggggaacggccttgctgggagttggggcctggcctggacctcgaggccactggggacttggctacctgagggagatgaggttgttcccagggtttcctcatcccaggggctctcagatttccagggactcgggcaggcacagctttccaggccagagccatggacggtccctggacacctgcagcagccaggccccagatgcaagaaagggtatttgtttcttaaagcttgtaaagagtttctaaaaggtggggaggggattggtgggggcctgtctcatgttttccattctggacgccggggggacatgttgctggggccagaccaactccagggagacaactcgacaagttacgaaacatccagcagcatccacgactaatttcttccccctgtttgtcctaccgtggaggtcgagttaaaaggcagcacttcgggggttgaaaagctacccgcaggggtctgctcgtgagggacccccgggcctctgcagcctttgttcagaggcagctaataagccgactcccgctgggcgctttgtagcgaggccgctgttcccagtcctagctcagcctccctgcctcagagggctggcagatcagcaaattgctgtctccagctcgcaagaggggcaggtccagggatgtgtttcacccccaaggtgtgagtggaatcagcaaattgtatcaagaaatatttctagggatttacattccggcggtcagcagcctttgggaggctttactccgcctgcaggggtgggaggcctcgcgtagagttggtgggggcagcagagcctgggtgtttcaggaggacccactcactctgggccacttctgatgctgcagatcacgccaggcaggcctccggccgtttgtctcttccgacagcagcggtggtgatggtcccctcggcctgcctggcctgcagcagccctggctggaggctgaccgagcctccgaggaggttcacctggagctgtctgtccatccatccatctgtcccttggcccctttaagaggccttgtcccctttgccagtgcagggagaccccaccgtggacttctcattgggacttccagtgagacccaactccactgcctggggataccctcaccccaagcccaaggagcctgtccctacgcacaccccctgcccctgggaggcacatgccgagctttcctgtcctccatttggtggccgcctcacctccatggggtcgcagggcccacacagacagcctactatggtcctggcaggcacagggtatgggaagccctgtgcccctgggatcaagcttggatcctgaggtcctgagcttggtgagtcagggctggggagccacaaagccagcatgctcctgccttttgggggtcccaggtgatgtgtcatcttaccaggtgttgacaggtggagagaggtaggctgggtgaagataggaaaggactatgggaggccagggcgggcctcgggtgcatgcctctctgtggcagtgacatttgtacagaacgaggcaaggccagcccatcctgggagctgagtgctggaccatgggggctgcagcctggaactgagcccagagactgcagcattcagaggtcagggatcaaggaggacctcacaaaggagatcgggaaggtggaggcttggtcacccccaggaggagctttttctaaggaaggagaggccagcatgtcagccacggctggtgggtcccactgaagctgagaatagaactggcagtggggtttggccacatggaggtcctaggggagctgatgagagcgatgccgtagccagggtcggcagtggcggaccgagagtgcttcccttctcacgtggttgggagtcatgacctgtttagtaaataggctatggcagcctcttggaacttagtgaggtggctaagctgcccctagatagctgtgccctgtgaccaagacccttcctccctccttccctctaccccaccaggctcagccaactgacaccagggccctgtgaggcagtatctgagccacccttctgagtgggagctatggcaagtgctgccttagcggagtgggggtgggggcatgtgtcactcccaggaccaactggcagatgaaggtctttgggcactgcagctgccacctggggtgcctcggggcaggctcacctcacacccttgtgggccagctgcggcccaaaagcctcctggcctccattcccgtgccagggtggtctgagcggagaggacaggggggatcccagacggatcctgaaaacaggctccgccttcctctgtggctctgccttcctcttggctccgccttcctccgtggtggcctgagaggggtgtggtgctgcttgtccgtggtgctccacacacctgccacagctgcttaccccactccctgccgccctggacaaggtgcccacggccctgtcccatttaccgttggggcaagtgagggacgaggaggctccgcagcctcccccgggacactgcaaccctcaagactcctagcaagcccctccgtctcagagccttggtgtccccatctgtaaagtgggatgtgacaatacccttcttgctgaatgggcagggagagaggagctgttaggtgagaccaggtggtacttggcagctgtggcacgtggaagccctacacaggcagccccacacctggtccgctgttctgtccttactgtagcagtgggcctggaggcagtggcatttagagaggaccctgaagtccaaagaggggatgccagcctcaaactcagcagctcgaagtagcaacagcctcgaatccctcacacctagcggttggctgggcaggtggactggtccgagctgagtggtctaggatggccttgctcccggagaagacccttggcagacagcctctcctctactagctagtggggcctcactaaccgctggtggccgcagggttcccagccactcggtgcacatgtactccagcctctctgtgtcccatttgctcatgacatggtggtcaaagcaagtcacggattccagggggacctcgggacgaggaagtcacacgttgggggatgtgccgcagggatggggcatctcagcctttgtatctgccgtgggcgtggaggcatttactcttttcaccgggggagcagaaatcagaacatggctctctgtgtctgacacagagccctgtactccatctatgcagcccccaccacctctgcacacagcccctccggtggtgcctgggggcccaggcttttgatagagaatcacatctggaccaggacgttctggtaagatcgccagggggccgcgacaaggagaccaggaaggaaagacagaaagaaaaacacgcacagatccaggctcagatgatatacagtcctcctcccggctcaggacccctttgcggtgtcacctttcggcatgtaaccacttattctgtcagggaggagagccctcccgctccaccaggtgacggccctaaatcctcaggagtgacagcgtcctcccgcccggattgggtttctgcacagtggaatggagctggcagccagggtccctgtcccgccagccctaggcctcgaaccctccctggcaagctaacactgcccttggaggaaggagggtgggagggcaaagagagagaagtggtgggtggcagcgagcaggctgtcctgcaaggccgtggctgcactgagggcagaaggggccttgtcacctaggaaggaccccactaggaaccccttcccgcggaaacacagcttctccccttgggtgccattgcagctgcacccaagccttgcccttccctctcacttcgctccccaggaggcgacactgtgattgtcctgggctcacagaggaggacgtggggacctgcccaaggagacacaggcaacagaaccagggctcagagttgggggaaggggccagttcacccacagagggtggagtcactgggctgaagcttctggccatcgtatggagctggaacaaggcactggaaggtaccaggcctcagcgttctcaactgtgaaatgggaacacggtggtctctgtcacagggtagagatgactgatccagtaacctggacagggtgccgagggcagggtctggtgtggctatcaggagccactggattggaacttggtgtgccaccagggtccctgtccgtttaagaaaagcctgtgggcccaatagagaagcacagggtctgagaagcatcagacaatgactcctaaacaagctcacgtcttgaagcagtgctggacccgtttcagctccaggggagagccagggcagggtggggcaggcacggattcctgacgtggagacaggaggaagccgacggccatctgtgctcagacccagtggtgagcctaagacaagttcccagaatccatccgggacagacggctggacttgtgaaacactccagggtcgggggctcagccacgggaccagcgcttgccagaaatgttcccagcttttttgagttcgtgagtggctggtggatacttagtggtttggctttcgggttcctgccttccaaaacaggagaggcaacttggcctgctttttcctcagaagagcccactttttgcgtggaggtgacctgccatttgtccggttgggggtccccaatcgtcttcgagctactgatatagaacctctgcgtttagctgtggtttaggaagtgcattcacgtgaagtcgccaagttcaaagggctgcccctggaacccaagtcagacttgccctcgcccccttcccgaacgtaccctttccatgaggctgggcgccctgccctgccttcagtgccaaagccccaggcccacaggctgtgcactccagccgagggcagcctggggaaggtacgagagatcactgggctttgtgaaacctgtcagcttgtgtgaaagctatctcccccaggccccacccccgcccccacccaaagcacaggtcacctgcctggttaatcatcctgggctctgagagctccctggggccccacaggccaagcgttttctgacttggagaggcaggaggccaactccccgctcctcagattctgctgaactaactgaaaccctaaccttcgggcttccccactaatttgtgataaggcctcgccaagaaaaacagcaggctaaagacccctgatttcttcatgaattccagagcacttggttcactccggcagagaaggggccccaggcagccatgcatacagagccacctctgcgtgggtgaagggctggggacggcctcttgggagcccactaaggaggaccacctgcctgctccaggcagattgcttccagctggccagggcagaggagcaggccaagggtgggtcccgggcagtggcccagagaagctgagctcgctcacgagatgtgtgctgacgtggcaagatgggcgggagtcttcatgaaggagtggctgcctggccccctgacctgaggatcctagggcccctggatgggtttgggggaactgcagcatcctcagatcacagacggtgtgtcgagtgagggtggtgctcttcctgggccagcagtaggtttccaaaagggcacagacacagctcaggagatggatgctgccctgtcagagtggggaaactgaggccccaggcggagacaccacccactgcaggttccagccgtcccccaccccacccctgccccaccatggctgatgtgagggaggtggccagaagtccagagggacactgggtgggaccccggtgaagatctggtggactgaggccagagaaaaaggggatgacccattcctagcagggaggaatagtagtttatattttcccccaaaattttatttttctgcattggcctgaataggagctgactttaatacgggggaaatagtgattttaaagccggctttcccatggaatgtgcttctcctgtgactgtgcccatctcctcactgcttggcagagaggtatcccccgtgccccactggcatgggcgccaggtctgcccttccagaggcccctcccaagtagctcccagcagaacacttgaagcccaaaagcagtgagaaagggaacacatttgcctccaatcctgactctccaagccctgtccctgcccccaggtgaagggttggccctgggcatggaggtcggcagcagggaggggacacttaagccacttggttgggggtttgtgctatgccctttcctctgccctgttaggtttgcttctacctcttaggtcctgtgatatatctgcccctgtaggagcgagacagacataagccagatttcaggaaggagcagccatggggcagtggggctctggagcaacagaggcctcaaaagctcagcgtctacagatgttagggacaaggaggcagcttgggggatgtgctcaggccctggaggcagacacatcagggtctgaatcccagctcaggggcccagggcagctcaagccctctctgaggttctgtttcttcatctgtaaaacagggacaatcacggtagctacgtgtggggcgcaggacggcacccaaggatcattcctgtgtgagtcaggtgtcagggaccaccaggccttgtgcaggaacatggggtagtgtccctgggggaaatcctaccccagactcgaggaataaagaggaggaggaggttgcctgagcttaacagaatgatggctgtctgacatgaggctcacaactggccccagcagctccacggcagggagcaggagcagacaccccggatccgctctcctccctccttgcctcctgccaggggtccagttggctagacccaatctgaagccctgggccaggagcttgtggacataacctgcagagatcagcctcctagggcagagtgagctgaatggagaagggctgtatgcagaagggcgagcagacagagcccaggattccacaacggtgtcgatgtacaacaccaagcacctggcctggtgtgggctcgtcttgcactatgaaggggcagggacgtggccaggcattcgttcctctgtgggcactgtggggctttgctgtggaggcagagggagcatctgatggcccccggggccgcgctagtcaaagcgcttcatttccatcatatgtggtgcaaaatctaaccctcttaccctgcgtgaggttcatgtgaccgctcccgctcacctcccagcctcattgcctccctgttcccctcctccctccccagccactctggccttctcctcgtccttcagctccttccagagtgttcttgcccagggcctttgcacaaatcccttccaggacttccgatggttctgtcctcccctcacacaggcctcacctcttttgccccctccacctctggagcggccactcgcccacccttctgccctgacttctctgtggcttcccaaggctcttcctggcacctcgtagggtaagtccgaccccaggtggctgtgctctgaggccagggccaggactcttgttcacagtgctatgcctgacccggcgccagccctcaggggaccacagccggctgaacgccaactggttagctgctttttctataggacctaccgagcgtttgactctagaaccgggggttggtgcttggtgacaagagctaggctggcttcctactaattctgcagcctctggcttgctagcctcccgcccactagggtccaggtcacttcctctaggagattctaaaacactctggcacagcccaccagcagagccgggccttgggagcgtgagggcacggggcctgagcctactgcatcctcccagaagctggcctacaggacggaggctcagggtggccagttgggcatggggttctgctggcccagagtgccagggggacaggaagtccctgagggctccagctgcaggaggagcatctcaggaggagctgaggccggagcagagcgtcctcctggtcctggcagcccttggcccctcagcaccccagagggccggccgcagtggatgctgctgaaccaccagaaacttaatctattattacacagaaacttctgtgcagtcaggggtttgaagtccccagaagtgtttgcctgatttggggcagatagcggggtgattaatgctcgtgataaggtgttgattggttctgggagccactgcagacacaggggctgttgtgcatgcagggctggcaactgtagtcacagaacaatagcccgtttatgtagcacactcccaccccccgcctgccccaggcgggcacaaagggcgctcgggccaggaacccatgagctgggctctcccggggccgagggtccagacctgttgccgagaagctgcttagcaaggcctaggggcaagggctggtctggcctagctctttctcccttgagccccctgccacagggctaaggccatgctgcgggctcgagtgactgccctggacgtgacaaatctctgtgcctcggtgcccacacctatacaatgggggtaataaagtccccacattgtagcactgccaggtggattaaatgaaagaagatagtgaagtccttaaagtgagatgtgttggcatttactccacaaatactgaatgcctgctccaggtgccagggacagcagtgacaatacaaaactgatacgaaattccaaagggatgtccaccaatgggagacgtataagggctctgcatccatggattcaaccaactgtggatggaaaatgtttggaaagaaagttgcatctgtgctgaacatctgaacttgtacaggctttttgtcttgtcgttattccctaaacaatagagtgggtcacgcagcatttgtgttgttaggtatcgtaagtggtctggagatgggaggatgtatgtggcctccatgtcagtatcacaccatttcgtatcgggggcttgagtacctgtggatttgggtacctgcgggaggtccccatgggtgctgagggacagctgcactttagtatttatctacagagtgcttggaagggaaaacaaagacaggcagggctggtttggggaaggggcctgttgtggatggggtcgtggaggaccttacagtgtccccaaagcgaggtgaatctcatggtgtcagggctaagagcattgtggagagagggtacagccacagcaaaggccctgaagtggggatgggcccacaggctggcaggacagcaaggagacccatgtgctgggaccccgagagctaggacacgtgaagccctggctggccccgagtgcggtgtggttggcgcagatggcaacagggtcactctggctgcagagccaagaatggaccactgaggggctgggacagacctggcagaccaggagggaggccactgcactagtccaggcggaggatggcagctggaccaggagggcgaggaggaagtagtagattcaggactgttttgagagggaccattttagcttcttacggctgctgtaatgaattcccacaaacttagtggctttaagtgacacgtttattatctaacagctctggaggtcagatgtccgacatgggctacattcaaggagccagcagagctggttcccactggaagctcaaagggaggccccacctcccttggcttgtggcctttccccacggcccccttgtctctgcttctgtcctgcgctcttcacaacctcccttcctccctctttctcttatggggagtgcaggggtgatctggaggagccggtcaatagcagcgtggtggggtctggcagagacagactgcagggggcctgggaggccccaggaggcaggtggactttgtccctaggcatccagtgcagaggtgagacctgtatggccacagagtctccctatccaggccccattaccctgggggaggcggattatggtatgaactgctgcaggtggtccaagaggggctgcccctgggagacgcagggttcttcagtaatggtggtttcgaagggcagaggagggaagaatggagggatgggggacagacgctggagccgttttggtggcaggcctctgtggctgtggccagaagcagggctgggcaccaggccagatggaccagaggctgcccccagctgaaccaactacagaaatgagagccccggcccagcctcctcccagccgccgctctctgggagcccagctttgctcatagaaaaggaaggcccttgttgccctgcattgggagcaaacacttcctttggcctcacagctcaaccttggacccaaaggtcctcagggacctgggggaaagagagggcagccaggcacctctgttcacggcaggggctgcgttgcccagcctggcagagggaggcagcccctaggtacagtcccctgtgcccactcgagggggtgctgaattcctcaaggcctgagtcagacctggtgcagcttcataaagccaagggtggcaggcggaatccaaggggcctcaccgcccatgcaccccactgttgcatggagagaacaatgcccaaatgccctcgtcccacagtcggcatgccagacccctcgggaattcaggccttggtgagtctggcacattccggctgtgtgtcagcgggagaggcctgggaaagggagccagcactgcaggccgcccaccacacgcccactcgggcaccggacacagggaaggcggacacccagggcggccatctctcgggacaggaggtgcggctccaggttctcacccaggagagggctttcctcccatgtcagagtccccttcgctgcttgaggcaagccctccggaacagacccatcttttgggggaccctgtggtcatggagatcaggttcctagaatcacccccagcagcgcacacaggagggcctgaggcccagagaaaggcgcctgaagcaagggaggggagggctggtccagagtccctgtcccctctgccagccacccaggaggctcctatggccccatctcccagctcttccgggtggaagacagtggtgggtaactcactcagctagagcgtctgatcacaccactgcagcggctgctcacagccttcaccatcaggaccacaattctgagggccctttggatgaagccatctcacagagctgtctcctgcagagaggagaggagagggaggccgccttgccagcaggggaccagcgaggtgtggcctgcaagccgtgggctcctgtgttccttcctcccccttcagaggaatgggaggaaaccaggcttgagttcctgatttttgccctttagggtttttaaattgtgggagagccaggagtgcctgcgtggtggcctctgtcgactccatttgctctgaagcggggctgcggccaggcagtgcctctcagccttctgtttggtgggtgaggacgatgcttggtcttgcctcaggagcattgctggcacctctcatgtgctcctgggcctctccccaaccctcaccttggcatcccccaatatccaaacaatagtccacaaaacaagctgccccgtgggcactgcgaagaccctcggggccagagccactccctcagggtgctgaggccaccagctggggcctcctctttccacactattcctgacgcctgggctgggcaggggactcctggcttcgtttcttccctcgcctttgctgggccatctttcagaccttgcctggtaccttctctccccgtgccaaggcctggaggtgatgtggatgcagccgggcagtgaggagcgcaggcgaatgttacagcaggcgcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctcgccttgcagccggagcctgggggcctctgtcccacccactggggcccagggaggggacccctgccctggcggtctcccctgccccatgggccccagccccatcttgcctgaggcaggggtggctctggtcccacccaccctctggaggcccagaaactcgaggctcctgctgggggctggtgaccacccacaggcagcaagccagccagggtcctgggaagagggggtctgggacacagccacacctgagcccatcctccacctggagccagccccttaccttctggagcctcagtttccccctctgtaaaataggaggcatcacccagccttgcacgtctccagtgtccctcagaacggctctggccccgcagctggggtctgaagagcagagccctgagctctgagatccactcccacccccacccccacccccaggcctctctctgccttccctagtgctcctttgtgtgtccagagggaaggggcatcctccatcagcactgaccccactcaggcctctcagctgcactcaacacaggggctccccacactcgccctccttcactgcgaccccgaccctcactttcccacaaaccctcagtctcctttgctcagcttccttccagacaggctggcccaggccctccccacggcttggcttccctgggcggtgtcaggcagggacagcagccataggtggtacccctagtgagggggactcattctagttgcaaagatacaggtagagcatagggaccccaaagagtagcaggggacccccgaggttgctgctggcagctcctagggagacagtcgggcacggtgggcaccttgagaggaagaacagccaggcctgggcagccctgggggaggagccaggccaagtgtgctgccctcttggcctcagatctgaagctatagagcctcctggagggcagaggcagtggagaggggtctagcgggcaggagggggacttcaggccttccacacacacacacacacacacacacacacacacacacacactctctcactctctctctctctctctctctctctctctctctccccccccacttcagggccttcgcgcccgctgttcccctgccctgccaggcgcaccacccccgaaacatgcacacgctctcctcttccctgcttaatcctcttgagtcttcaggcctcaacccacgcttcccctgaacatcctcctcagagcagttgcgcgctctaaatcaggaccaccttgcggttctcccagccccagccttgcctttctagtggttctggcctctgatcacaggcacagtttcaagcttgtctagcactggcaggggtggtcctgctccggccccagggcccgcaggtgtgtgtgagaggtgcatggtggacgtccaaagaataaacgaatgaaccatccaaagcacaggccagaggcagattgggagggtcaggtcctaagaggcctcaggccggagcccagctgcagagcagggcaggggtggccaaaaggcgcctagaaggctggactttccgtgaggtggcggggagcaccaagggtagaggcaggggagcaatggatgggttgaatgaggaagcttcacagccccccggccaccgcaggtcgggggagcactgtccccggggccccgcagccagctgtgctgggcaaggcaggacgggatccttggtgatgggcagaatgtggggagcagggtaggacgggccccttggctgagagccagatgtggggagcggggctgtcgaggctgatctcaggatgcttgctgcggctgctgggtgggggataacaggggttttccgaggccctgaaggactggagagtaggagcaggtctcgggggtagcttcctgaagagatgagtcaggtcccaggcacattcagtgccagccagggaggtgagaggtaatcctggaagctgctatgtagacagaagcgagggcaagaccaccgctcctccgccataaaccgtgttggatgggcctcctgcctcctccagcctcagtttcccccactgtgaaatagggatgacctcctgtgctggggcctggctgtggcttcccaggccccggctgggaccaccgcagaggtgatgtctccaggaggcttctgggccagcagcatgttccagtgcgacacatgtgccccggagtggccgcgtgcccagccggctgtgcacgctgccccaggctggtggggtaagcgcctcggagggcacactaacaagaggcacatgtgccagggaagccctgccttgtcatcacctgtgccgtggctgtcagcgcgcatctggcttacattgaactcccccataaaacgtgtgaaacctgacagcagcgccgcagcaggacagggagggactgtgtgtgagagccagggaagggctgctcagggggctctccttgatggtgaccccctatgagacgccacttgccctgaggccctgggggacagcctggcccctggatggccagagatgcctggggccctggggtgggaggtggggacaggctaatggcaattgaggccctgcccggtggagggtgggccatggccgcccccacctcccctcccgcaagcttctccccttccttcagagcccaaccactgcttgctccttcccacccctcctaggccagggatgcctgaagccacactccactgcattcagccaccgtcctgaagtgcccctcacccacccatccacaccccgcaggcatcctagggcctggcccaccaccctctccctcctcaccattttctgttgagcacacttgaggagcacttggaggagctgggggatgacatgagtccactccgctgtcaccaccaagaccacagtggggcagtttaaacagcaggcattcatcccctcacagccctggaggctggagtccaaggtcaaggtgctgcagggctgggtcctcctgcagcctctctccgtggcttgtagacatcaccttccccggtgttctcatggggccatccctctgtgtgtgcccgagtcaccttctcctctcataaggaccccagtcaggtgggattagggctcacccttatacccccattctgctttaattacttcttataagaccccatctccagacacacagtcacagtcagaggcaggaggaggtgggtgagaggaccccacgcccttcctccagtgtgtctggagccccttccctgtgtacaaagggacagagaagcgagggggctccttggccctccagtatgtgtgtgcagaaggcccatgagctgcctggggttggggggtggtccttatacatactttagatgccagagggggctcattgggcagaacctacctgggaaggggcccaggcttcctgcctgcccttcagtttaccctgtgctcccaaatctgaaggaagcctttcctaaccagcagtccaggggattagaggactgggaccagttgaaactccattctaagtcttggggacctaatgggattaaaggcgaccgagcttgggccgtatctgggatctggggcccaccgggggctgtgaatagttggagccctggagtgccgagggcccaggtcccaggcctctggggagtctggattttttggagtcttcctgagacttgtgaccagtgggcttgggagagcctgaggggcctctggggttagacggtggcccccgtgcctggagagaaggtgcactttggggatgggaggcgctaggtgccaatggccctaggagggggctttggagctggacccttgagggagtcaatgccagctcatcgccatagcggcttgcttagggccgtccctcccaccccccagttacacagcctgcaaaccccaacctagccccttccaggtgtcccttgtgatcttccgccactgacataggtgtggcccagagcaaagggcggcttcccatttcacctgcgcatctgcagctggtatgcggctgccctggtgggttcctggctggctggcatgcgccctgcgcctctgctgggcctggtggggcctaagggtgaaaactcggtcaagataagatgcccacggctcagggaccccacagtcacaggtggggagtggcgcagagcctgggcctgcctcgggctaccctgaagtgccagccgagggtggctgaggaagcccagtcccgacccccaccgcctgccttcccaagacatcctgagtgcccctcgccagcactccctgctcggggatcccattattccaggaggaggagccaggggtaccactttccattagtgggtccagaagagatcccagcgggaaggggcagccttcagggtagggcagcggattagggaggactcccccaggagaggaggaggcaggcagggaaattctggggggagtgtattccacagggtaagcagaggctggatcccgagagcatctggacttgttcccagggcacccagcacagaagtgaaggggtgccggtggagagggagagccccgggcagctgctgccgtgtgggtggatgtccggccactgcccagccacctctctgtcccaggaagctgctctcctggggcatgtgcacctcaagtgggtgcagcaggcccagacccacgggggcccctggaggcctgctggatgcccgcgagctgcaaggagttaattcctggccttgtgggctggcaaactctgactcacagagcaataaaattcttgtgttttaaaaatcagtatattagcttaattttatagatttcagaagtgctacttgaaaataaaagtctcctaattatatttatgatcccaacgtgagtgaatttgactccgttcacggcgaagaagctttgtgtaaaatgccgggaagccttcgtgctgactcggccctcgcagaccataaaacacggctggtgggtccgagcccggcagggatatggggtcacagcaaagtccctattaatgccatgtccacctcgctgccagggagagtggggctgcagcagggtgcgaccgtcacagccctaactctgtgatggatgcctgctgttgtgatcatggacatgaggatgtgaggcggtcataatacaggagtgggctggaggcagggaaaggggttggtgccccctgcccaggggaggcacacctgggggcacagaatgacactgggtcctctcagcttcatccatttcctgctccaggcagggccctgggcctgggctgcagggattcaagggagaaccacaccctcctccactgctgggaggggccgagcctggcctggactgctggccccaggagcctgggcctgtggtcagggcaggaaatggagaagatgaacgaggaaaggagaaactgctccaaatggtggggagggaggagagacgagggcagaagtgagcccctggctcggtgggggtgggctgtggagtgtgggggcacagcgggttccttactgagcccagggggaggcagggtctggagtgtgggggcacagcgggttccttggccatgggggtgggcagacgtgttatcatgaagccgggagatcaaggaaggctctctgagggaggtgacatttgtaccaagcaaggaaagaggcagaagatccttcttccaggctaagcgccatgtgagaatgcagcaggtcggggccactggcactagcgtgtgtgacaagggaatctcaggcttctgctcacctctgctgggggcagagaccctggccagagccatggccaacctccccccactcccagccaggcctagagcagagtgcccttggaggctggaggaggccaagtcagcctgtcccatccctcctgggcccccgagtcaccaggagatgcagggcttagcctggagaggggcctgtgcggttcctgggtgttcaggggtggggtggatgtctgcttttcctgggggccccacagctgggccaggctgtcctcccagcagaacgtgggctgcagcactggccacacagacagaccctggggggattgtccttctgccacctgggcattggcacactggccttccgcagacactcagcaggccaaagagtgggctatcatcagacgctggccccaggcctgccctgttgttgcgggtgcagtgaggtgcctgcggccaggtgggtgagcgaggtgcaggctgtcactcaccagcagggttggggcttggggggaccctggtacaggtggagtccaggggtctgcagaggatggctcgagccctgctaccaccatgctgctttgaaaaaggactgacttctctgctgcctccgcctccctgtgaagtgggactgacatcccctgtcctggggtggccttgagtgtgtgcagtgcgtctggcacaggcaggtaccccacatgtgtgcccagcatgtctgggagggccagggtcgcagcagggcccccacccatcctggctggctcatacttggccactggccacaggtgacaccaacccagcccctgtgtgaggtactgagagcccatcacacagatggaccaaccaaagccacagatgacaggtggcaggcccgagattgcctgaggtcacatggtaacacatgtgcacccggcagttgtttctgccctatctgtggttcccagccatttggatgtcacagccccatcaaaggtccgctacatattcccccacccccaaaggtggatggacataggtgggcaacatttttattacgcaaaaaaggacatttcgtagaacaacattactctaatgaaataccaccatttcattctagaaaggctgaggactccatctcagaccaggggctggtggtgtcctggttttttaacaagaacttgttctcactctgccccagcgtttgtcagcccagccatggctcctatccacggcactgggcccgcagagctccaggagctgacatgctccgtcttaaggcaggtcggctgctccgaggactgccggccctgtcagtatggtgtccttgcccagctggtattggccaagttgaccgtgtccaggggacagagagaggggaggggcaggttgttggaagcctttctgcagatgtagcttggagcagtgtcctaagggaggccagcccctatgggtcgggacagaggcctcaccagtgggatccagtcactggggctgaggcctgggtgtgcaggtggggtggtgagccatgcggcagtagcccctggggactagagcaggctccttgtggagctgtgcggagctggccggcctggtccccgtggcttcaccctgagcgtgctgctgcctaggccctgaacagacagaggcaagccctgcatggcgcccagggtgccagtgactctggttgctctcaaaccatgagaaacgttagaacttctttacccctctgtgagatgggctgggcctggcctctgaggagcctccaggaatggcaggagggagggtgggggatggggagtgggtgctgctgcccatcgacgctgctgggcaactaacaaattcagcaaattcttctttttattgtgtatgttcgacaactgccttcacttaaagtcacttttttctggctctccaaatatacttagataaggaaacagagtctatttaaggaacaatgttaagcaaacaatagtacaggtgttcaaagatatggaatgagtgacagatggggcgagggaccccgatgcagccccacccagaggacagcgcacgcgggctttgaagtccttcctggcaggccccgaatgtgagcgggtggacccaggcctcctgggggcctcagctcagctggagccagggtctctggaggggcctgggttagtttcctgtggctgctggaacaagtcgccaaaattttggtggcctaaaatcaaggtgtcctcagggctggtcccttctggaggctctagggagagtccctgtcctgcagtttcctgctcctaggggcgcccacatcccttggatcatggcccctccttcaccctcaaaggcggctgcggctcatggcatcctcacatcacagactctgtgcgtcccctgcggccacgtctcctcctctgactctgatcccctgcctctttcccgtatcaggacccttgtcatcacattgggccacccagagaacccaggattttctccccattgcacgatcagctgcttggctgcctgaattccatgcagccttgattccccttcaaaggaaatcaagtggcaaaggggaattgagtgacgcatgcgtgagttccaaggattagggcatagactcctttgggggcgccctggggtggggggtgttcctgtgtctccctgcagcccctgcttggacacatgaccagctcaggcagtgctgcctccgggggaagtcaagagtctctggtgagtctcagacaggcctcagagtgtctcagggtggcctcagagacaggggaggcccctatgagctggagggagtgtgaggacagggcctcctgtgagagggcaggtttgacttttactctgccgctgagtgactgtgtggcccaggcagtcaccccagagaggtctgactggcgcttgccggggtggctgtgtgcagcaggcattggggccctggagatatttgctctttctttttgttttattatccagacttgcaaggccctgtgtgccccctcggggctgcacacgtgtacgcacaaacgcatgcccagtgtgacccctgtccacacctggtgcctgtcccctgtgcccctgtttatcccttctacctacagcctatcccctacccaggcccagccctcccagctcaccctcttccaacccaggcctgagctctgttcgggtctctatcctcctgccctttagcctcctctcttactgatagaacattccagagcattccaccaccactggcctgcaattatcaccccatcgctgtgagtgggggcaggctgaggaagctgtgctcgggccggagcacagccggcctccttgcaggggcagctgcgggcgcgcagacagctggggctgggagcctcttccagggatcctccgcctgtggttttcctccttgaccttcttaggagggtccagttccttctcctggccaaggccccactctctgccaccccaggcagggccagggtgggtcaccatctgcagaagccctcaggggcccccagcagcgcccctcctatccccctgccccagggcgggctgccgccttgtaacccccagaactcttggctctcatgtatatgagtcagcgttgactgtttaacctgttgcaagacactctgctgggtgctgcgacatggttaggttttctccacattagaaggtagaaggaagaaaaataagttctgaaagaaacagacttgccctgcctctgccctgaccttgaggtgaacagaggttttgcacagaacgaccatccctgcagcgggtggcttggggggtaccaccatgatttgagaccctgggtggtgctggccagaatcagcctctatgagatgggcagggcagtccagggcaggggaagccctgtgccccaagatcagatacatcagctacaatgagaggcatcaggcggcctcaggccctcaagccggtccccatgtgcccatttgcagtctgtctcatactcacggccacctggccactgcaccctgatacagcagtggggccttcatgcctgtggggtgtctgcctgcccagctgtgcccactcatgtggtggattcatcccaatgctggtcctgggggccctgggctccccccggccctttctcggggcagtttacactttgcagctgaatcaatcaggggcagaaatgcctggcaggggaatgtttaccgatttggttttctggggctgaggatgctcggtgtttgtccaggctctgtcctgctggctcctctaaagctttgcaaacaagagcctcggagagaaggaggccttcccctccccatgtgctgaattcggggcggtcctgacagccatgcgcgggggcccgctgtggcctcctctgcacggctgctgagggaatgcaggtcaaacaaagtaggccagcggcttagggacccccgagtaagcaggcagacccacaggaaatccagtgctccgagcccccacacctgtggtgtggcagccacccagcaagactggaccgagaggccacgtgggcagccacccttgccaggtgggcacagggagtgcaggtggtttgttcttgcctcagatccaggagagcagcttttttgcctgaacccactcgtgaatttttcatatttttggagagctccttgtgaggacagccggcctgagcaggctttgatgaacattagagcaggtggccacaattgggcagatctgggcctggagacccagttgtcatgtttgagagggaaggggcattcccagaaatcacagggatgactggtgtgagcccaccgcccacctagactcccgtaccatgcggggcccctcattgactccgagggtcttcaaggccctgtgctcctccagaaggtggggtctgaggtgctgctgggtgtctctcttcacctcttcagaagcattcatgaggtaagaccccaccccttcaggccctggcacaggcctcagagcaggcccaccacccaactcactggttcacttaggggtagaaattatcccagcttttacccagagctcagggcccaagatgtcagtttgcctgccggctgttgctctgactgtggcctccctcccagctccccggcatgcagctcccagagggagaacttgagcagggaagggaaggggctcgaatccctacgccagtccctgcatggccctatggggacttgcgtctccccggaggagagcagccctgcgcagccctctcttactgattcctggagtctgcacagctacatagggtcagattcacgacctcccagctttaaccagccttcttgattagccgccatctaaggcccaactgtgcttcgtgacaggcctttgagcctaaaaggagttgcccccagcaatgacatcggatgcctgtttagtcagcggactgcctcagaaaggaatctcacaggcagcgggttcttctggtagggtgggatatttcagcgggaggtaaacaggtgttgtcacagaacggcagactggggcctcccctggtgggccttgagggtgctggcctgcagacctgctcctgcccgttctggcctgatccggggcctcttgactgcaggtctctcgtgggctctcagccccaggtgcctgccctcacccacgtagcttgggacatcatcagcccattgccggtacccatggtaccttcaccaccctcttggccgcattctgaaaatcaatgtttagtccctccttgaacttaaaaagtcaaacttaaaaagagattattacagggagctggggactcaggcttgcaccctgcctgtttaggataaaaggccaccgtgtgtccactctagtgtctctgctcaaacaggagacgatgtggcatcgggaacaccaatgcggcactcagagaaggctcttagccagctggcccctgatgggctcactggctgcaccagcttgtgtagcagctgagctcctgcagagccttctgggagggaagaatgtgtttcttgctccagtactgcagagcatgtgatacctgcaggggtgcaagaggtgcctgagagcaggcatagccaagacttgtttgcggttgctcctgacgcagagccggcacatgaggtggcgttccctcactctctcattcattcatttattcgccagtgtttcctgggccccatgccatgccaggtaccttactaggccctggggataaaaaagaggacaaaagagatgagaccttcatcctagagcttaggatgtgaactgcgtccttctttaaatggaaatttctaaattacggtgtaccgaatgcatccacccttggcctcgtcacatgtgctgttgggcagtattttcctacattttcttctgtgaaatttataattcagcctttgtcattcaggcctgtcgtcgtgtccaggtgcacctttgcattcggaagaatccagattccttttcctccgtggagtgactccccttccccacctgccctgcagccattccatcctgtctatggtggtcgatggtgtcatctttgtggtctagtgtgttcccgagtatacaagggtgtgtgatcggggctccctctttgcactgatagtctgctggtcggaaggacaatggcggcaccccaagacctgatgctctggtttagaaacgggttctaatgcccagaagagctcctaaacccctatttataataatctctttttaagtttgacttatctgtttgggacctttattcctccatgccaactttaaagttaagtttattgcatttcttaaaaatttcaactggaagtttgcttgggattgcctcgaatttgcaggttaaatttgggaaaaactggagtctctctcatgttgcgttttctcctccaagaacaaggagtctctctgcattgagtcaggccctcttggacctctgttgccatcttttcctgaaagggctggtggggtcttgcttccattattcctggatgagaccttctttcccctgctattttggaattttttctcccaggagtttattgctggtataaagaaatgccattgatttgggggggttgatctcacacctgacaaccatgtcatactttctatcagctctattgattgatcttttgatcctgctgattgtctaagtggatcggtcctatcaggaggagtcagcgtgaccacaggcccccattccccagcccctaatgttcttgcctcatgtcttcaggtgcggggctggcagaggctggggttacctgacacttgtcatccttctgctgggcctcagcacccggcggaggcaggggcttcctctgacacgatacagggatttgctgacggttccttgtctgctcactaagcgtgccttggagaaggccgctcagcgagggccgccttcaggcctgagcccggggccaggaccaggagcaggcggcagcagcaaggcagctcatcctcggctgcctcttctccctcactactatttggtttttgttttgttttgttttgttttttgagatggagtctcattctgtcacccaggctggagtgcagtggtgcgatctcggctcactgcaaactccacctcccgggttcaagcgattgtctcacctcagcctcctgagtagctgggactacaggtgtgcgccaccacacctagctaatttttgtatttttggtagaggtggggtttcaccatgctggccaggctgatctcgaactcctggcctcaagtgatccatccgcctcggcctcccaaagtgctgggattataggcatgaggcaccatgcccagcctcttgccgtcattttttttattttaaataaactttgattttagaatagttttggaattacaaaattcttacacaggtggcaccaagagtccccaggtgcccttcccccagcagccctattatcagcatctcacattagtatgcatttgtcacaaggaaacaacagtgctacatgactgttaactgagtccatgcttgatgcagatttcctcagtttccctactgtcttttttctctccccgggccccacccagggtcccatgtgacattcctcatccgtctccctgggctcctctgggcggtgactgtttcccaggctctccttgttggtggtgacctggacggttcagaggaggacaggtcaggtgtttgtagggtgtcccttactaggatccgtctgctgctgtcctcacgattcgactgggctgtgggtgtgaggagggagagcacagagggaaatgcccttctcatcgccctgttccgagggcccatcctgtcggtgtggctcgtcatgggcgatgctgtctctgtctcctggctctgaggccgtggctgtcaatctcttcaactgtgatttgttcttttccccctttgcagactgtccttggacccgccagcatttggctctggggccctagagagaccctgggatgtggatcacactggtgacccctgtgagccccactggggacagatccaggaagggacctcctgggaatgaggtctggcctctgcctggatcaaagccatggcccccattccccggggatagggaagctgtgcaggcagcctgggtaatgggccaccgccccaggcaggcgtgggaatccacacatggcccttctcaaagacgggtgctgtccctggggctctggcggggtcctggagcctctctcattgggcacatccgagcccagcctggcccatggtggaaatgcaaatctaattagtctggcattgagcccgtcttaaaagtattaacagagccttaaactgtgctgttggacggggatgaagaaacgccttagaaagaaattaccggatggtgacaaagccccaatttattagtcttctccaatggggactgtgcaaaggacattaattactttaatgggacttattttgcttcgttgcccaaagtaattggtttattaacctctccttccctttagggagggagggagggaaagactggggcctgggggtggccccgggaggggctcgtccagccttctgctcctctgcccagcggtgcagccttgcaccctggggcagccggtgcttggtccctgctggcctgggctggggctgccccagtgcccactgatctattcttgttcactaggcatccaccgtgtgccagtcactggaatacggccatgagaaagacaggaccctcaagaaacaacctgttccctgaaggccataagttcactgttgtcacaggtgcccagaggaaaggaagatggctttgggggtggacacgtctgggcaggcttcttgcagaaaggccacaggctaggatggtgggaaggcaagagaatgccgggaaagggaggactggttgcccacagggagtgggggtcatgggggcaggttccagagatcagaaggaggtggtgggaagaggcacgcagggtgaggctggctggaggcaggtgaggcagcccagcctcaggagccaggaaccagcttccccgggctttaccagatggggagcgataagggctgtgtttcaaaacaatccctctggcgtgaagcaagccgtcttgaaaacagaccagaaccggctgcttccaccaccagcagaatacttcaagaagaccactcgggcctagggctctgcaagcaatatctgattttcagaaaaccatggctcacccacactctaccctaggaaagggcaggttcccagggctgggcttgtggccagtgcagcactatcctcagtggcctgggacacccagaactggccaggaaagacccctacacagacccccagctctgcagtcagccctgtctccttgtgtccccagacctcgggcgagggagaagcaagttcccctcaggaatgctggtgaagctggcatgcccccaccccctagctcaccctgggtccacgcagggcctgctcccagagtgaatcccagaggtgtgcctgccccacctgtcccagtaagggtggttgtgtgtgttgggtagatgtggtgaggtgtgctggtggggagggtccctatcagatgcccctgggtacctccccaggcagggccctcagcacctgatgccaaaccaggctccactcttcctccaggtgagcccgagggcccagctgggcgtccacgtggaggtgtggggcccgggtgggacaagcctggcaaccaggacccagcatgaaactgcaggtgcaggagccccagccagcctggaatgtgggggctcagaggccacccagagcccacagcagggactccccacgccaggcccggctggatcacagagcttcgggtccagccagctgctgctgcccctccctctgggcctcaagaccatctgtcacgtgacaggggcaggctaggcctttcttgaactcactgtgagctacagagactgtgttctggccaggtgaatggtgcccctgggggccaagatccccacctctggtctggcagctgggtgtgcaggggcagccccagacctccagagtgccctcttcccctctttgcggttgtcaccctgtccttgagtctaactggggctgtgctgcctttgacgtgagctattcaaaatggcgggaggggcgaggcctctggagcaaggaaagagagtggtggctgtgtccagcaagtccctgttgccactgatagcataaaaagtaactctgaaacctggtggccctacagttgacacacatggggccgcaggaggaaggaggctcaggccaggccaaacatcagagacctcaggtctgtctcctttaccaaatggggggctgttccgccagcaccccagtagggaggatgagaggatgccatgatttccagggtggtgtcagaacctgtctgccagggctctgcagggaggggtttggggttgagattgggagacctagaaatcgaggggtgtcgggggcctcggctggggggcaagcacagatgaggatggaagcagctcagtgtcactcagtctgcactgggaatgggggatcccaaggccagggctctgcctggtgccaactgtgtgaccctgggcacgctgctgagcctctctgggccccagttcccttattcgtacaacgggaatgatcgaggagttaacatgtgtttaaaagcaccgaggcttggccgggcgtgctgcctcacgcctgtaatctcagcactttgggaggccgaggcgggcggatcacgaggtcaggagatcgagaccacggcgaaaccctgtctctactaaaaatacaaaaaaaaaaaaaaaaaaaaaattgtccgggcgcggtggcgggcgcctgtggtcccagctactcaggaggctgaggcaggagaatggcgtgaacccaggaggcagagcttgcagtgagccaagattgcgccactgcactccagcctgggcaacagagcgagactccatctcaaaaaatatatatatattagctggatgtggtggtggacgcctgtaatcccagctactcaggaggctgaggcggggaaacacttgaacccgtgagttgagatcatgccactgcactccagcctgggcaacagagtgagactctgtctccaaaaaaaaaaaaataaaaagtacaggggctctacacggcgccctgagaattgtgtgtaaatgagtgaaaatggggtgagagggagggagtgggaacagccaagaggccaggaagcggagcctgggtgcaggggcatcttgctggtgaagctggggagagacctgcgcaaccccacctgagtgaggcactgtgggcccagagtccaggtcagcgccaggggcagcaggggctggatctctggggaagttgaggaatgacatgtattccagggaagaattgggccggaggctgaaacaggacgacagagccctcagcccagggcggaggacatgggagacgggggtatagctgttgggcttgtggctggcctggcctaaccagttgggggaatccatgggaggctttagccctgctctgtgaactgctgggccttccttaggggccctggggagccttcccagcagaatgtccaggctcctgctggcccaagctccaagttctctggctcccagggtctgtgtggaatccaccggtttcaccccacgtcttttcctctcctgcctggtaaccctctctgcagaggccctggctggaccagttgctttgcaattcacaaggctttggaaggcagtgctcacaaatcacttttctagacgaagaccagtaagaagcccatgtcattcttctgagacattaggggttttctctcccttgttttaatcaaccagttcccaataagtcatttcagtcaggccattaccaatggctcataatctcctgggctgctgggcgaaatgggatcccctggctctttcactgaaaacacttttcttgttttctttctccggcatgctggaagccggccaactcgccagttccattaacttaatgagggctgacagcctgcgacaaacgtcctcataatctccccaggatttaaacggggtcctccccagctgcctgcctacaccccaacctcgaggctctttacctctgtctgtgcacccacccagcccctcctgggaaaaagccaggacaaagatgtatttcttcgctagctccttcctggtggctctgtgcaggcagcctcagacctgtaggccctctgcccaatttgggtcacccacagcccccgcaccccacagcaatttcttgggagctgatcatccccaaagcttggaactacaaggcagtgactggttttgccgggctccgctcgtccctctgagcggagggtcaccctggtcaccatgaaaactttatcctcatccacacctttctttctccaactagcatgggaatcagtttagggtcctcccacaccctcatccaaaccctcatctcccaccccccacttgcagagaaagccccacgctctcagcagaaacggacgccagcgtttaggagcgggtgggctcccggaagggggctctatgggaaaggggaggcaaggctgagcagctgcccaaagtgagcatctgtcccacgttccacccccaggaaaccctctctcctgacgcggggacttgcgtctcagtgcagagggcagtggagggacagtgcagctccgaaatgagcatctgagttcactgctggtgggcaccatcccggccaacaggccactagtgtgttctccctctttcaaacggggcggcgaccctcgtctgacaggcggctgttctgagagcggtggctgtcccagggaagccctcggtgagcgtagcgttaccatggtttttaaattaaagcatctgcagatgcgctgtgtccctgcaagggcaggcagatcgggaccccagggactggtccccatagccaaggtgttcagccgccctgtcccctacacagagtgcctctcccactggctcagggtgagggcaaaatggcacttgcagaacatgaggcccggccagctttgccctattccccccatagcatggctgaccttcctctgagcccctcgtggatgcccacacacggcaagacgtttcctcaaagatgctcttctgcaaagctgcactttctcggttgccgctgccaccttggcacctctctggggtaccttgtactgccctgtcctccccacgccctgaggggccgtcctaggcagcactcaccctggtcatccctgtttccaccacaagactgtttgtagccgagcttgggagttgtgttgtgtagtgttgacttgagttgcatcgtgttgtgttgacttgagctgaactgtgctgagtgttactgagttgaggtgactgggttgattttagcttcacaggtgatctgaacccagctgagtggcttccatggagctgatctgaacccagctgagtggcttccatggagctgatctgaacccagttgagtggcttccatgaagctgatccggactaagctaaactgagtttcattgagcagcttgtttagctggtgtgtgccaggtggtctctcggggggtccgatgggatacctagtgtcttaatctgttcagtctgctataaccaaataccttagacctggtgattcatacttaggaattcattgttctggagactgggaagcacagggtcagggcgccagcagatctggtgtctggtaaggggtctgtctgattcatggaagtcagcgggctgtgtcctcacgtggcagaagaggcaaaaataaggtgcaaacaagctccctcaggcctcctttccaagggcacgcatcctcttcctgaaggctctgccctcacggccgaatcacctctcaaatgcgccatctcctaacaccatcagggctgcgggttagctttcgacatagggactttgggaagacacacacattcagactacagcaccttgctcctggggaaacagaggaaactggttcctttctttcggttctgggttatgtcaaaatgagttccctttgctgaatctgtttcagccacctctcccgaggatcctcgcacaatttcactgccagccaggaaggtctgccctggctggtctgggcttgaggaccagcacgggatcgttctcctctgtgggtcgctgatatgaaaacaatctcacaaagacgtaagaaccacacatgcttagtgtcatgtgtgatgcatcaacccagggggaggagagaacgtgcattcacgcagaactctctcagccacaagctctgtttctgttgcatttgggccaggttgcgaggagcctggcaggccacccggccagtgtggatgtcattacatgagcagtaggaagccatacagtatctgaggcgggggagtcacgagatcttcagtctgtccctcggaaagcccctcctgccgccactcagggggatgggttggaaggggtgaggctggagcccaaatagggagttcagaggcctccgtgtctgcccagggaaggagggaggccagcttcagctgctgtcctgagggttcctgcctgggtccctgatccccctgagaaagggctccctcccagaaaaggcatgtgccctgggcagagccaggaaagctggggatgtctcaaagcctccctacctgctctgtgtcccctccctctggagcctgcctctctcccgagcaaagtacctgccacctgggagtgatctgggacagtcagatgcaccttttgaagtatacacctcagtggcttttggtatattcagagtcatgcaacttcacgactctctaactttagagcattttcatcaccctcaaaatgtcccttgcatcccaggtacaaagccataccaggccccatggggatggcttgtgactgctgcacatcctgcccctggaccttactctagttcttctttcatccactggtgtattcctttggccggggacacacacatttgagaaacttcccagcttccctctatctgaggctcactccattacaacacaaggaactgagacatctgtggctggttttttttgttgttgttgtttttccaaattgtatatctgataagggatgtgtatccagaatatacaaagaggtcttacaactcaataatgcattgacccaattaaaaaatgggcaaaggacttgagcagacatttctccaaagagcagatacaaatggcaaatgatcacaggaacacatgcacatgaacacacgctcagcctcagcagtcattaaagagatgcagatcaaaaccacagtgaggtttacacccagtaggatgactaaaacaaaaaagacaataacaagtgttggcaaggatgtggactgccagagcgaggctagccatgccatgtatctggaggagggccctggaggggtgtgcccattgcatgtctgtgtgttcccatgcagtgggcacaggcagtggtgccagaaagagcctctgctgggctttctcaccaccccagcctctcacctgcagcccaggcatcctccagtgggtttttcagggaacttaacatgatgagtctaaaatttctatggctgaataaagaactgaataaaaataaccaagaagatcaaggaagggccctgccttccagatatcaggatgtggaagaggctatactaactaagatgttgcagtgtaggcacaagggtagacaattagcccattatcccagtggacaagacagagagccctgaagagatccatacaaatgtgggacattggcatgtgaccaaggaggtgttgcaggttgctggaatcaatcatcctccagaaggaaaaagctagagttgggcccccacctcatgcaatctataaaaactgactccaggtggatctaggaattaaatgttaaaagcaaaccttaaaactcttactggataatatacgtttattagtatcttttataactcggcatagggaaatatttattttacaagacacaaaagcattgactgtgaaagaaaaacattggtcaattcgattttacaaaataagaatccctcatcatccaaagataccttaaagaacgtgacaagttgcagactggcgattgcactagttttctggcactggtttaacaggtgacccccaacacacatcagaataacagacgtttactctctttcacttctgtcggtcagaggtccaaccccaggtctgatggggctggagggcgtcattagggctagaggtcctaggggaggatctgtgtccttgcctttttcagcttctaggggttgtctgcattccttggcctttagccccttcctctatcttcagagccatcatgttcctcctctctgacattttttttcgtaatcacagctctctctgaccacagccaggaaagagcctccactgtttgttgttgttgtttttgttgttgttgttgttgttgtatggttttgctctgtgacccgggttggagtgcactggcgcaatcatagtttactgtaaccttgaactccctggctcaaacgattcttccacctcaacttcctgagtagctgggactacacgcacgtgccaccgcgcctggctaattttgtttaattttgtgtagaggtggagtctctctatgttgcctaaactggtcttgaactcctggccttaagtgagcctcccacctcacccttggccttccaaagcactgggattataggcatgagccactgtgcctggccagggccttcacttttaaagacttgtggttaattgggcccacctggacaattcaatatgatttccccatctcagtgttcatgaccttaattacagatacaaagtcccttttccatataacgtaacatattcataggttctaggacatctttgggggagcccttattctgcctaccaaagaaatggatattcacaatacaatgaattgataaagaattggtgtatgtataactaatacataacatgtataatgtatttatatatgtgtgtgtataaccaataaaatcactaatagaaactaaaataacgaatcaataaatatacaaattatcagacagaaaaatggccaaagacaaagacttgttctgcccttcatggtcgaggaacacatgtggccagtgagtacgtgaaggcaccatttacagaaaccatttacaccactccattggcataaaccacagtctgaccattgggagcggtggcagggatgtagggcccagggtctctcctacattgctgatgggagtgtacagtgggactaccactttaaaagggtggcatcacctccaaggtggtgaattcacatacctgttgacccagcagtcccatatctgggcatacaccaaaagggaactctggtgtgtggacgagtgagaatgaacaggagtgtgtgttgcaacgctgttcacaagctccacgtgcaaccagccacttgcctcccagcaggagggagagtgagtaaacatggaatgcccatacaaaagagaattttaaactaattaaagcaaacaagccagagtgacagacaaccatgtgggaaggcttggcaatataataccaaggaaaagcccactgcattcttatcaagtttaaattactaaaattaaaaaaaaaaaaaaaaacatgacttttgggacacatatagtttcaataatattatattaaaaaagaaagcaagggagagaggaacacaggattcaggttgatggttacccaggataggggagacaaggatacagttggggtggagctgtcagggtccagcatttattttgtgttttgtttgtttgtttttgtagagatgtggtttggccgtgttgcccaggctggtcttgaactcctgagctcaaagcaatccgcccaccttggcctcccaaagtgctggaattacaggtgtgagccaccacacctggccgtctagcgtttattttgaataacgagtccttgggagctttctacattgtttttaaaaactaattatatgacattttataagaaaattatattagcacaaccgggagagatttattctaggtaatgcaaggctagttaacattcaaaacttaattaatgtgatctattatggaactttcccaacttgatcaagagcatcttaaaaaaaaaaaaaaaaaaaaaaaaaaaaaacccacagctaacatcacatcacacttaatagtgaagaacagaatactttccccctaaaataaaaaagaaggcaagggtatctgttctcaccacttctattcaatatagtactggaagttccagccactgcaataagacaagacaaagaaatgggacatgtagattagaaaggaggatctaaaactgtttctatttgcaaagatagaattgtctatatagaaaatcccaaggaatctacaataaaaatatctggaacttaggagttcagcacacaaaaatcacttgcatttctatacactaacaatgaacctgtgaaaaccaaaattagaaacaataccatttacaattgcgctaaagaaattaaaatacttaggtataaatttaacaaaacatgtaaagatgtatatactaaaaactacaatatgccaatgaaagaaatcaagacctaaatcaatggagagatattccatgttcatgaactggaaaactcaaaatagtaaacatttcagttctccttagaattacctataaatatagcataattcctaacaagaatcctagcaagatttcttatggacatggacaaacttgttctaaaatctatatggaaaggcacatgctgtagattaaaacaattttgaaaaagaattcagtgggagaaatcactctaccaattttaaggcctactatacagtaaggaatcaatatgatttgatattggaggaataagcatgtagctcaacagaacagaacgaggaatccagaaatagacacacgcaaacatgcctgactaattttaagacaaagatgcaaaattcagcggaggaagactcctctttcaacacacggtacaggagcagttggtcattcataggccaaataaataaattaaaaccctgacctaagtctcacactttatataaaaattaactcaagagccaccttggacttaaatatgaagtgtacaactctgaaacctttagaaaaaacatagaggagatagtatttaggatttaggaagggcaaacagttctcacattggatgctaaaagcatgatctgtttaaggaaaattgatgaaatggaccccattaaaacttaaaacacttgttttgtgaaagccccagtgaaggggataaaaatgcaaactatagacttggagaaaatatgtgcaagccacatatttgacacctggcatctagaacatgaagtactctcaaaactcaacagtaaaaaacagcctgtccaactagaagatgggcaaaagacacgaagagacatttcaccaaagaaaataaatagggaagaagtacaccaaaagatgatcaacttcgttagcaaagatggaaatgcagattaaaaccacagtgagcggtcactacgcacctatcagaatggctaaaatgaaaagtaatgatgacaccaaatgttggcgaggatgtggagaaacgggattgcccatctgttgctgctgggaatgtaaactgatgcagcactcggggaaaataatgtggtcgtttcttataaaagtcagcatgcgactaccacacatcccggcaactgaactcctcctgggcatttatcccaaagaaacgaagactcatattcatacacaaaactaaatgaaaatttatagaagctttattcctaactagctgaaagctgagaacaatctatgtatcattcaacaggggaacaggcaaacagtggtgcatccctaccctgaaacactacccagcagtagaaaggaacccactatcggtacaacctaagcggatcttacgggaattgtgctgaggagaaaaagcctcccccgaaaggtcgcatgctgtgtgattccgtatagataacattctcaaagtccaggctgtagggatggagatcagatggtggttcctggggttgggaatggtgagggtgggagtgacttgcacaggagacgcagagggggtctttctggtggggaggacttccattcctcgttgctgtgtgaatctgcacgtgtgaacacaaggcagagccacgcacactgtaccaatgtcaatctcctggcgttgatctgttactccacccatgcaaggtgtgaccgtcgcgaactcacgtagagggcatacaggacctcttggtactttttttttttttcccaacttcctaggagtctataattgtttcaaaataaaaagaagcaaaacaacacactgggaggtgcaggaaaccacacacgtgatgtgcttgtgtctgctgacataagtgctcaaggaagagtctggaaggcctgcaaggccctcatgcctacgaggtggctgctagggggatgtgacgtagagtgacttcagtttccctcttcatgtctcctgggtcctccagcactctgggtttcctctgccaagacccccacccatctgcctctcttcatctcacaagcctgcatgtgtgcagagggcaggggtccccaggggatgttccttccccaaggcgctgtggccacttagagggtcccccaagctcgggcctttgaagacagctctgtgtctcctaggacgcacaggtgtgggacctcactgcgcgggagggagttgcaaagagcgacaccccagcatgtgggaaggaagggagcgagctcttatttccttattttctttccatctccactcccaggcaaagctgataaattcttccttattccagagttagaggatcctccagaaggggccgagagcttgtccaggcagggtggatacaaggggcttgcatctgacttaattgtctggctgggggagaggggacagaggtcctgggaggggctgaaggctcagggacacaggtgaggccagcccctcctccaccctgggcatctccaggcccagccccaccctgagctgtactggacccaagccccaggaccccctggagtcacctccagccctcccacatgccagcccctaccctgggcctcaggatctgcctggatggaggccaggccgctgagctgctgggaatctgttccacaggtgggaaggtcggcccgccatgggcagcccagtccgggaaacttcctgcctctgctttcccacagtgtccttcgatggcccccagtgacgtgtgttgaatgtggcgctggccccttgggcagcccagcagcccccaccccagccagcccagcctgggcagcactgggggctcctggctttgaatttgacctatccagaaacaacggctccttcagtgggctcagcccctgagaccactcagcctgggctgtgtgcccagcggcacttcatgtacgtggacggggcaggcgggcaggcgggcgtggaggagctaatgggtaagttaggcagcacattaacaaatgaaccagcggatgggggtggggagctcatctcattcatctacaaattattaacaataacttgttcattaatgaatgaacaggtgagatacaggtcagtgggtgcatgaatgagtgaggagatgaatgaagcgggtcttttctcagcagctgacccacggccaagcccccgctgggcagcacgtcccttcctcctctcccaagctgggtggtgcgggcagggagagggtccatccgcccttcagtaggtgaggaagccacgggcctggagggtggcccagcccaggcaggagggcaccagccccgggccctcagtgccttcctgcaaccagggtccaggggtcacttccttcacggcccagtgagcccaaggcctccgtcctgccccctgtctcttaccagctcgctcctgcatcagtgctactgaaatgggaaaggtttccttgtcccccttgcaggacatgtgacaggggtgtggctcgcttcttcagtgccccactactcaaagttctaggggagcatacagtcggacaggttgtggggctccgaccccacagcagcgtctaggggtgaatgtttacagctgaagccccatgggtgtgtgttacagggtgctctttagtttagccgtccatagacagcttgcgttagtcagctcagttagaccccctgccttacggcaagggcagaggtctttctgtatcccgaggttcttgccttggcgtactggaagaatcagatcacacgtgggcttggagaatgagtgcaaggttttattgagtggaggtagctctcagcagatgggggagcaagaagggagatggagtgggagggtggttttcccctggcatcaggcggctcagcagcctgggctctcctgcgtccaccccagccaaacccttcatcgttcctccggtcaatggtctgccggcctgtcggtgcctgttggtgcctgtcggtgtgctcctacgctggtgtgttcctctcgacctaccctcaacgtccagccgcttgtgtcttcttctgccgatgtgttcctcttgatgtccagccgcttgtgtgtctgcccactaaggtctcgagatctttataggcacgggatgggagcatggcaggccagggtgttctcgggaaatgcaacatttgggcagaaacaccgaaatgtctgtcctcacctgggtccgtgcacataggccgtagggtggaaccctagccagggacccgcccttctcctcccagcacttccctgcccctcttccgtatcactaccaggaaaggccacttggccccatcccaggcctcgcccaagacagagagagagacaccaccccctgcaaaggagcaagccgggcccttctctctgagaccacagggtggactgtgttcagcagaaaagccaggtagccagcgctgtcaccagagcagtggctgacccacagcatggcctggacagagctgggggcctgggctggcaccctcagccctggctgcttgcagtcccggccggctgtttgcctgtgaaggctccggctgtgttctagggagttggcaggaggggaggcccgcagcagcttctagcggcctgtgaagcagccacggggcatggccctctgtgcagaacaggatctgaggagccccgagtgttctcactggatgtggggccgcatccagaccttggcggtcatggccacaggctcccaaggccctaagtgacagccagtggtagacccttcacggtcaggcacctatgactccccgttccctgcctgctcccaggctgtttggggtgatggaaagaggccaggacgtgaggccagggtaatagttcctctcgtgtgtcaggcctgggaggggggccttcatgagaccatcacggagatcttggggcctccaatttgtcaaatagttttctgttacagttcatactgtttgcgttcctttaaagacgtctttgcccatcccaggtcgtgaaaatattatccaactttcttcgacaggcccgattgcctcatagttaggcctgtgactctccctgggttaactttgtgaccggtgtgtggtaaggatcatggttgacatactttcacaggtgcatccacattgttccagcaccctttattgaaaagcgtatccttccgccagctcgacggcaaaggcgtcttttctatgaaccagtggccacaggagggtttgtgtgtctaatgtcctattccacgggtccccaggccacagaccggtacccatccatagactgttaggaacaggaccgtgcagcaggaggtgagcggttggcaagtgaacgtgatcacctgagctccgcctcctgtcagatcagtggtggcattagattctcgcaggagcgcgaaccctgttgtgaatgcacatgtgaggggtctaggctgtgtactccttatgagaatctaatgcctgctggtctgaactggaacagtttcatcctgaaaccatctccccccaccccaccccgtccacggaaaaagtgtcttccacgaaactggtccctggtgccaaaaaggttggggaaccactgccctattccgtcagacccccactgttcatctgtctgcccacacgctcttaatcaagccctgtggcctcatgaaaccctaggagtgtcagacctctgactttgttgttcttcaagatcgtcttggctattcttggcccttcacgttgttaggaatattttagaatcaccttgtcggtttccaataaataaacaaacaaacaaaaagcactgtgatattgattggaatcatatttaatccacacctcaatttgcagaaaattaacatcttataaatattgagtcttcttatacatgaacatactatatccccaagtcaagttagggcttctttatctgtctctccaatgctcagtgcttttctgtgtagcagtcttacacatctttaaacagatttattttagagctgggtacgatggctcacacctgtaataccaactacttgggaggctgaagtgagaggatcacttgagcccaggagtttgaaaccagcctgggcaaaataacaagaccccatcttagaagaaaaaaaaaaaaataagaaagaaagaaagaaagaaagattgtgaaagcaagacagtaaagaagaaacaaaaaacttttttgaaagatttattcttaagtttctggtcaagtttatggttattgatgctattgtaattgatatgttttattttctaattgttactagcatatagaaatatacatatacatattttaaaggcagggtctctgcattccaggctcagagcttacagcagccttgagctcctgggctcaagcagtccgcccatctcagcctcctgagtagcaagaagcacaggtacacaccaccaagcctggctattttttaaatttattttttctacagatggggtctcactatgttgcccaggctgatctcaaactcctgggctcaagtgatcctcccaccccaccctcccaaaacactgggattgcagatgtgagccactctgtcaggcctagaaatataattattatatatcatccttaaaaccggcgttcttgttaaattcatgtattccaacagtttatctgaggattcttagggattttttttacatgtatggttatgtcatttgcaaataacaaatgttttattttttcctgtccaatccttgtaccttttatctcccttttcctacctttttaacataccagctgggagtttctggacaatgtgaaatagaaacgataacatccttgccttgcttcctgtctcaggaggaaagcgtatcacatttcactattaagtatgatgtctgcttagggtttgggtttttttgttttagtttttgtcttttttttttttaggtaatggagtttctattcctagtttgctgagagttgtgtttttaattatgaacaggtctcgctttatcaaatgctttcttacaatctgttgtgttgattgtattttttctgacttattctgttgatgtgaagagtgacgctgcttggtccttagagggtaaactcagcatgcacaagtggattaaaccacattcgagcatgtgtttgggcacagtgctacatgcagcttgctggtggtggttaggatatttgcacgtatgttcacgagagagattaacctgtgattttttttttctttcttgaaatatccttgtcagattttgatatcaaggttatgctgccttatgaaaatacttgtataaaattgacattattttttccttaaacatttggaagaatttactggtgatgtcgtctagatacagagttttctttgccagaagatcattaaaattccaaatttaacttatttaattaatattgggcaatttggattatttttgtttttgtgtctacttttacatactgtgtttttaaataatttgtatattttatctaaatcatcaaaagtatttttgtttgtaatgtcctctgaataaatgtttctgcacctctaggtctatagtgacattccatctttaactcctgatggcggtcatttgtgtcccctcccccatctgatcagtcttcccaaaagtgtgtctgttttattagtctcttctgagaaccaaattttggctttgttgattttccttaaataatgttcattttttatctcatagactgtgctcttaactttatctcttccctcctactatctttggtaggaggcaaatggtaatttgccatttttttaaccgcttgagatggatttcagcctttcctctgctctgagatatgcatttaaagccacgaggttcactgtctgtgcttatttcactgtactttcagtacctatttggctatgaattttaataccttacatttttattactatttaatttaaactgttgtttgattctcattatatatttttctttgacccctgggttatttagattgtttaatatccaaaatacatggagattccctagttatctctttttatggatttctaatttaattgtactgtagtcagagagcataataaatatgatttgcctgctttgaaatttgttggaacttgcttctgaagtcttgcatatggtctcttttggtacatgttctgtgtgcactagggaagcttatgtagtctccagttgtagggagcagtgttctgtatatgtcaagttgctaatcaggctgttcaaatttgtctctgacttgacaaagctttgactgcttttctatcagttactgacgaggtgtgttcaaatctcccaccattttctcttttagcttttagttctgccagtttgctttatgtattttaaggttatgtttttaggtgcatacaaatttagaattgatctcgtcctgctgaattgacacttttataaataggacatattcttctttagtaatacttaaagtctgctattggttttcctttactagttttcatttggctacaccatgacctatctttttctatcctttcccaacatgtttttgtatcgttatattttaaagtggatttatatagttgtttttaatcatgacaatcttgatcttttaattagactattaatccacttataatgtatgcaatctaccatcttatgcttctttttcatttgtttcatctcttcctttaagtctattttcttttcatgctccaagctggctattttctttgggttcacagctattcttttctactctgtcgtccctgctatccaactcacctattgcattcttcatttccattatggtccttacttttctggaacttcctttttatgtatctataaattttatttctctggtaaaattgtctatcttttcatctattttcttgaacctatttatcatggttattttgaagtcttcatctaaatattctgaagcaaagcacaatcatctgttagctcacaaatctatgggtcagcaatctgggctgcccagttgggtggtctcacttggattcgatgacatggcagtacttgcatggtgatgtggtggtggctgagtggtctctgttgtcctcacgtgtctggagccactgggttgtcagccagggtctctcagctctccttcacgcggctgttccagcaggctagctcagacttgtccatgagccaacagaattctaagagggtaagagtagatgccacaaggtccttgaggctgagcttcagaagacatgatcatttccaccatggtggagatagactctagcctgcaatgggaggaaccacaatggattgtgcccatctttaattaatcacagtctgccctctggccataacttttcgcattctcccctatgcaaaattcactcacccccctcccgacgatacctaaaattctcacccaattacatgtggcatcatgctcaaagtccgacatcttgtgatctgccccttccagcctctgtccaattccttgtcccaaaattaatgctgtaagttttaggatattgatatgacattacctatttcttagtccttatttctgtatcagttacctattgttgcgtagcaaactagacctaaatttagtggcttcaaatattttctttgggccgggcatggtggctcatgcctgtaatcccagcacttttggaggccaaggcggacagatcatgaggtcaagagatcaacaccatcctagccaacatgatcaaaccctgtctctactaaaaatacaaaaattagctgggcatggtggtgtgcacctgctactcaggaggctgaggcagaaaaatcacttgaacccgggaggcggaggctgcagtgagccgaggttgtgccactgcactccagcctggcaatagagcgagactccatctatatgtgtgtgtgtgtgtgtatttttttttttctttgcttagctaggaggttggacttggttcagctaggaggttgttctgttggtgctggctgttagctgaggcctctctcttctccatgtggcctctctaatcagcaagcttgtttgcagggccacattccaaaaggacatgaattatataccgtgtacattccccagtactctttcatcagtgaagtcacaaggtgaccccaaattcaagtaataggaaaacagactccatctcttaatggaaggagctgcaagtatttaaggctgttggaagtaccacacctttagatctgtatgatctctcttttcccttgccttttagtctttcgtgtataaaattgtagatgctcgagggtattatctccctacagataattttattttcttctgccacgcgcaaagcaccttactccagtaggggattgagagaggtggggttaatgtgatggaaagttggcattgcttagtttctggggctgccttctagatagcttctaaaccccaaagcttctctccacagtgccatgcgtctactgagtactctgcttagcttttaccccttcagcaactgctttttgctcagtttctgtgattctcacccacccgtgtggcttaggaattcacaagtgtttccagaggaagttgtgtgaaaggtggctagaggaccagaatctttttccctcgtgtcctggctgtcctgtggccctggactccacatttttatcactagcccactgggcccccaccctgttgggtgtcagtgctccccaaactgacaagtgccctgaggaggaaacgctcggatgcaggcgcagctcagttcatttcctttctatgtgggatcctcaccttctatgtctttcttggtctccaaagcctcacacagctgttccttgctgttggcatcacttagtctcgcagtccctggtgtttccatcaggaaagtcaggcaggcgttagcttcactgccaggagggaatctcctgtggcctccatggcgctgtgttttcttccagtcttttttctatgcacagacacatcatcccctttgtttccttttgtgatgctgtttctaaaaggatctttatttctagaagaaactttaggaggcaaaaacagcgcagcccccttaacagagtggctctggtggcaactttcccttgttaatttgtcctgtagcccctactttcccaagcgcttgctgtttgtggggctacaggacacagcagctgaaaggggctgtgggcatcgccagcatgtaccctcttatcccatttgctgacaaggatcctgaaggcccaagcatagaaagaagttgctatggctgccatgtgtcagcagcatagccatggccaactcagggccctgactcctacctgacccccttctgaatgacactcaaggtaagggtccccttcccactcacagatgaggtgaaacatttcaccttgaaaagcctcttgcccccagcctcccctcgagcccacactgggacatggcctaagtatctccatcccatggagttgaacactctccttgtttctggaaggatccagtctgcgtgctcctcaggcagtgcaggggcagtgaggggatgaccagcacagggtggccactcacaatctcctctcctctctccactgcaggctgcgggaacaccatcgggccaccattaaggtcattcgacgcatgcagtactttgtggccaagaagaaattccaggtaagccctgtgctgagccttcctgccctcagcctgcccctcgcagcctgatgcagctgcccacacctctcctgggttctctcctgcccatagtggagggtgtcaaggcctccgcccccaagccacacaggcaggcctatctgagacctgacagtgcctaccccaccgaaccccagacagcaggcccctcagaggacctatccttggaggcccggcctggaaccagggacacatgcagtgtcttcttcaccaagtagaaggcagcagccgtgtagctcactcagtcctcccgtggggtgggtcgtgcaaggcagcattagtgagagatgtgagggtgacatcagaatgactcagagatggtgcggagcctgccctgagtcaccaagctgggaaggcaggtcccccagaccccccagccctgtcctccactggctcagtgctctcattccctgctcctccaccctctgtgagttgggaggatggagggaggctgggccctgctctgtaagaggtggggtccccttggccaggtgaggctggagctccagggcttccataagctgccctaacttctccaggggcatgtcccccctacagaagccccttagagcccccagagtccatgccccgcagagaatgccattgatggcaggcatgtctcccctcctgccttggggacattcctcggatgaaggcggtggtggggggtactgagtcctggcttggaaatacatgtgtaggtgtgggaaccccgtatcctctgtggtgggtgatccagaaggcaaaaatcacaaagcagggaaggctggggggtgacttgcctgagtcccttggagcggggggcgtgtgacgtgcttgagtgagtgcgtgtctgcaggagcagggcagggtggggcttctgagctgggggcccctggcacctcagccacagcctcaccagtcataaggcacagcccaggaaggctcagcaatgtccgccgaccaccaggacccacagtcggtggcatcccagcccaccaagacttatcctggagccactgagctccctgctagggtctggtcagggcttatgggggcctttgtcaagaggtcgttgggtcgggctgggaagatcatcttgacttcaggagcctgagatgagccaagataatgcacagcccatccagacggactgacagtggcattcaagtctggtccccctgcagccatgtctttcacaccaggccacaccttccactccaggccccaggattgacacaggcccgcccacagtctccttggtggagcccccacccatctgggccctggagccacctcagcctccagacttcacagggcggtctgggtgcagaccctggcacaggcagccctgggcaagttcttccccagctgtgaggggaatgagagcctaagggtttggcataagatcatatgcacgtgcctcacccgggccttgcccccagcaaccccaggccagcacccgctaggctcgtcgtcactctgagccccaagagcagccctcggccaggcccttgccaagagcagtatgcgggccctcgttctggccaccgggccaccatctccaggggggtttcgcatgcacagccctcccacagtggtgtttctcagctggccctcccacctgcatccccccagggaagggggtggttcatgactcaactgaaccaagttgtgtcaaagctcccagcagtgcctgggacctcttgcagtcaaaataaaagccatggcaaatgccactgctggccagtgcccggagatctgcctggcatgttctaggggagatctgacagcccctgtggaccagggtgtctccattctgggaccgtctcctctctctggtgctggcatggagggccttgctggagcagggagctcactcgggggcaatggaagagagaggccagcctcctggcagcaccagtgctctcccagacagggaaggggctgcgtgaacccctttgggactcagatctgggcagggcagtcccccgagggcagaggagaccatgggaagggccagggtgtgtcagttcgctggagaacagcatggtcgtgacagccgaagcagctgacgtcaccccagcagtagagcagagggacacagggagcctcccagggtggggctggtgtctggcctgagggtgcagagcaggtcccagcagggcagagccagagcccaccaaggcttgcagaactgcgccacttgggcatcctgggggctgcttccaaggtctgggggaacccagcagagcatgcagaccctgatggctcctgggcaggcctagctccaggggtggtgtgggcagcttccagctcaggtcaagagatcatccagccatccctttctccatcagccaggaaggacactggcattgaggttgatatcaaggatatcccatcgtgataataactaccatggcttccagtcttgtggtgaaacctcagatgcgtagcctcctggccaagcgtctgcaatttcatgttgttggagcattcgttgaatacctgggagttgcagctctctgtaagtttgatgtggctgaaccaagaaaaaaagcacacgatttctacagatattatgatgccgtcaaagattttgaggtgatgaggaaggctggcatctttcagagtgcaaagtgattttggaatataaagaatttctttgggttgaattacctagaagcttgtcagtgacctgtgttcctgaactgtgaaacatgaatatatgggccaagaaatggtttctcttggtaaataagcaattaacaaatacaaaaagagagagagggagagggacagagagagagagagagatcatctgcgccagccccagcaggccctgtcgctgagccacaggtgaaaaagctggtccctggggaggaacacagtgagccctgcactcccttccagacaggagggagtgggtcccctttcctgtcttaggacacaggccgggaccctgagaatggcccaggaggcttcctgaagcagactgggaaacccccaccccactgtctgcttctccactgctccctggccctgggagccttgcagaaacctggcaacagcaggatcctcgcagggcacagaggctcctgcacaaagccgctggggctccctccgacctcaccagctggctcttattgctgggagcagcatggaggggtggggccagggtgaggggagcagtagcccgtggcagtgaggagctgtgtgtggctccaggggctcccctagcccacctctcaggatgcttcccttcctcgacgcctgcctgtctgcttgcttgcaccccaccccacccccgctggcctcaggggctgctgacatggcaggtgacccctctgcctaccttgctggctgataagtccttggccaaccacccctgtgtctggcccaaggagccggagcctctccacccttcaagtgtgccttgaactccctgtccaccatcagtcagtctggacaggcctgcattatctcggctcatctcaggctcctgaagtcaggatgatctttccagcccaaccccagaggaccactggacaaaggcccccgtgagccctaaccgtatcctagcaggcatctcagtggctccaggataagtctctgtgggctgggatgccaccgggccgtgggtcctcatggtctgcgggcattgctgagccttcttgggctatgccctacaccaggtaaggctgtggctgaaggtgcagggagctctctgctgataggcccacccagccctgctcctgcagacgtgcacacactcaggtacataatacttccttgcccacaacaggcctgtttggaagcactcgcatctgcagaggctgctaacacacacacctacacccacctggtcacagtggcccagagactcctagggcttggttttcccctgccctgcctcccttcacctgcccacaccgcacccagatggctggaggtgccccatgcttcagcttcacagagctctgtggtctgcaggaggctcaccaccatgactcatgccatgttcaatgtgttctgaagagaggcttcggccacagctggctgtgactctggctctggcatggtgctggcttaggattccctgacctttctcaactcccatcctatgtcatcctcactccctcccttaaggcagagcaaggcagtgctcagcatcccatcttagagaagagagcgtagaatctccatcatacagaagggacatacggaagggagaaacagagttcaacaacccgtcctacagaaaggaagatcaaggctcagtatcccatcttatagaagagagaggcagggctcagcatcccatcttgcagaaaggagcttagaatctccattatacagaaaggagaaacagagctcagcaactcatcttacagaaaggaggatcaaggcttagcatcccatcttatagaagagagagacagggctcagcgtccaatcttacagaaaggaggatcaaggctcggcatcccatcttatagaagataccaacagggctcagcatcccatcttacagaaaggaggatcagggctcagcatcccatcttacagaaaggaggatcagggctcagcatcccatcttacagaagggagctcagcattttcatcctataggaaggagaaacatcccatcttccaaaaggggggatcagggctcagcatcccatcttacagaaaggaagatcaaggctcagtattccatcttacagaaaggagctcagtatctccatcttacaggagggagaaacagggctcagtgtcccatcttccaaaagggaggatcagggctcaatatcccatcttacagaaaggagaatcaaggctcagcattccatcttacagaagggagcttagcatctccatcttacaggagatgctaccaggtacaagagatgctaccagatgctaacagggctcagcaacccaccttacagaaggggaggattgaggctcagcatcccatcttaaagaagagagagacagggttcagcatcccatattacagaagggggaatcaaggctcagcatcccatcttatagaagacagagacagggttcagcatcccatcttacagaaaagagaattaagactcaacatcccatttcatagaagagaactcagtatctccatcttataggaaggagaaacagggctcagcatccccttttacggaagagagagacagggctcagcattttatcttacagaagagagaagaaggacttagcattcccatattacaggagaaactgagacctgaggatgttattactagcctgtacataagtacggtttttacgggccagagggtctgcctagagtccaaccccatgcctgcctctatcacagttcttggtgtgtcatttctgggcaatgccggcgatcctggtgcccagtgtggccccaggagcagcaggcccttccttccatggggcacagctgtgttgtgaggacacgggccccatcccagccctcctgatctcaggatctcccgttcagggcccagagagtggctagtgttgccagtgagggccctacctgcttgtgtcaggtggaagaggaaccccctgaacttctgaggcccagcctttggtagggaggaggtctctgccctgtcttgggattcctggggtccaaaacaatgttgggcgggctgtaagaactccaccaagcctccggcattggtggcagaacccctgggcatgtcagaagtgtgtctagagctgaaagtgggtacatggagacctgacctcagggtctccccatctgggaacttgctgcttcccagggtagaagtggctgcatcctcagattaaggtcaccctggtctcaggagtaggaccccaaagagaggtagcaggtgggcagggagggcatgttcccagacccagcccgggccctcaacggtacctgagcttcctcctttctcatcctgggcctcaattgcctccctctgacttgggctggccctgccccacccctccccaccaagccgcttggctcgtctcttgggccttgcaaattccccagcaaaaggcaggaaagccactagctcagtgctaaggtggctatttgagcactaatgatgactaccctgggcctcacccggtcacccagtggcctctcgggatagaggcagtctgttgtcctatgtgctggcttgcctgcagggccaaggccttcctaggccatcaaacccctgctcagcctggctgctccacctgagtgaggcccttgggagcaaggccacaaatgtggcttggggtttcctgatatcatgagatgctttgttttctctgttgtggtttcaagatgtcacctgagtcccacttataggcttagagctggcaacaagcctgggagccctggggtcccctgccctgcctcacatggccccagccccactgtgggagcccaagcagatgctcgtcacccacagcaagtgctgcaggctaaggccgtcatctggggccacccctgctgcctggcacaaactgccaggaacgatgcagaggagacccgctccctaccctgaggacagtggcggctgcagccagtgagcatgtcaagggtcagtctggggcccaggtaggtagtgggcatgcagagctgtgcctcctggtcagtgcctggcactgtgctgctccttgaccccttgggggggccagctcttcctgaagccattgagaaccagaactggtagcctggggtggtggggggtggaagggaggagacagcaggcccctgccggtgagtagacaggaagctgggacccagagaggccgagctgatggcccaggactacccagagacccatggccaagctgatggggacaagcttcgctactgtgcacgcttggaaccaggcttatgccatcaccacataggcgagctcccaggtcttcacaagcctcccgagggcagacactgtcactgcctgcactttgagccacatggctggggcacagggaggagaagtgatgcgtgtctttttgtcccgcagcaagcgcggaagccttacgatgtgcgggacgtcattgagcagtactcgcagggccacctcaacctcatggtgcgcatcaaggagctgcagaggaggtgggcacggccaaacggcagcggggagggtgcccaggtcctgcccagcccggccccagctgcatgatcagcggtgccggaggagggaggggctgagaccctgagttcttgcctctcaaccacccccttctcctcaccacccccagccctgcagagggagggcagctggccacggccacggttcacagccagcccaccaggcagctctaccttgttccccgcccggatctgagatgatgggggaattggggtaggggaggcgcgtaggggaggcaaacacccgcctccgtccctgctcaggtagcaacaccagcttcacactccccacaacttcaggacactcggcagccagcccacccgccttccctgtcacctctgagcaaggggccaggcccagccctgggaagacactgcctggtgccaggccccaccgcacgggtctcccccagactggcctggagctggagaccctgactgtggggagctaatgtgttcccatggagctagcaccatcctcccgggcctgcacagactcagagcagctgtgcctccgagatgggctcgcctgggaactagctccgtgtgttacagggcatggctgggagcccgtgtccatcctggccacaggcgaggggtcaggctgccttgcccatggctgatccactgcctcccactcctacccccagggaggaagtctgagaggcagcccaccgactccccctttccgagatccctgctcagccccctcgggagcatggccctctggggggttgggagtgacctggcaggccttagggtcgggggtgtccccagagtgggtggacagtccactgtcttgccgggcacgtcaagctgtctgtcccacagacgacagtgcatctgcgcagtgccagggccaggtgtgaactggtgtctgtgtccttctctccaggctggaccagtccattgggaagccctcactgttcatctccgtctcaggtgggtttctgtgtcagttactctgggcccagcagcctgcaatggactctcccgcacctctgccctcctggctctccccatgatgtcagaatgggccattgcacctccaaagtgcatgacatgaaatgaaagccagggagtaaggggaggtagaccccacccttagcaaagtggctccaaagtacattttacaaaggaatattcaggtttcataagaacctacctgggtccctttaaattccagggcgttgaggttaggctctaggtgtggaaacatgaacccagggcaactttgcagaagggggtgatcctggggtggggtttgggtggggtgagctgccagcccagaattcaagagactatgggtgggggccttgcagggctcaagttgagagggacagaagcacctggctgcagcctgggggctggttttctggctccttgaccaaattccttgggtcccctggacacggggctgtgagtcattccggggaatgacagggaaaaggcacattccctggggtttccctagcccagatgcaaacagcagccacggctcatagtgtgggctggtgtaacggagcagcggaatggctgtgcccccagcctggagtcaggcctgtgtcgccctgggagtggaatggcatgggcttgcacagctggcagtgtggccagcttaggcagccccctagggctctcagaggtcagaggtggagagcgtggagcaggatggagcccaggtccccagctgcagccatgcccggccaccgtaccacccctggtatttttgtcatagcatgctttttaaaaatgtcctagtaggtttaggcattttgactctcagctacctcccccagccctaccaccccacttcccaagcccagctggggtccccggcccaccccagcacttggccctgatttgggtgttttatcccccatagaaaagagcaaggatcgcggcagcaacacgatcggcgcccgcctgaaccgagtagaagacaaggtaggctcacgcgccggcctgcggtggttctggttagcgtcctggggccagcaggcacctccctgtggtctgcgtgtgaacgtgaagctcctgcaggcctccccaccttcccgccagtgcctactgcagcctgcccagcaactcccaagaggggcccaggcccactgcccacctggcggggcattggtcccccatggaaggagccaggccaggctggtttctcatcctctgacaagtggcgtctttactggcaggtggcaccaagtgccccctccccccagctctttcccgctgcctctcgtagtctgctttgtgctctgcgagcctcctggctgtgtcctgagtggagggtggcagaagctggcctcacatcccagccttctcctgggcccagctgtctggggcctccacttggggccggccgagggctcagggaggtgcagggcccagctgggatgggttcatgggaagagaggcatcttctgttcaccccgaacccaccaggcccccactccccaccaggctctgtgcccatcactcggtccctcaggccggagcctctcccccaggcaccctgggagctgccgggggatctgggcggtgggagggcctttctcgggcccatggctgagcccaccactgccctttgaagtctctgtggtttgaagcgggctgttatcttgccgaacagcaagtccgtctacatggactttatctgaaagtagctgagaggctaaaaatagaggagtttcagttgggcagggagtgcgtctgccgcccggtttccctggcaacgcctggctctggcctgcttccatctcggctgcagccgggcaggcggggcaggcacagcccggcccaggctcctgctcctgccccacccgtcctggcccccaggacctgcagcgtcaccctctccccacctggcaccatctgcccatggcctggggcggccgtggggccctgagaccagcaaattgggtcatgcagaaagagcgaaggctggtgttcaggtgcctggccccatggggctgtgtgaccacagtaccctgagtcccatgggcctggccaccctctgtcagcacagacctgagcagggctggtgcagacctttgccaggcagatggcccagtgggagatagcgcccatctggcaggacaggaagcaagacccgggagaggtcagctcacaggattggcaagctcagaggcccagaagccttggcctctctgctgcccggggaacacggtgtttccctggctttctctttgcgcaagggctgggtgactcctggctggcacacccagtacagcagggccgggtaccctgtgttgttggcatggccaggagtttctagacatcaaggaaagccgtggtagagacagggagtggcacccagttccccagcctccactcctgcttccatctcggctgcagccaggcaggcggggcgtgaacatccctgacgtgcaggagtgtcggtggccctttctggacagcacaggctggggacagcccccgcctttccccgccactccctgccaagctctggttccattgcctacactactgtcccagacctttcttacggctctgcccctgctccatgggacaggccaccctctaagcccagacctggagtctggcatcctgcgggggtgatggtgggtggcagacagggcctcctgaagtgcaatggccccttcctgacgtgcacagcagccgtccagcagcctgctggggcctgggaacaaggacacagtcctcagtcagccaaggtcggtgtgggggcctgcagaggggccagcgctggccttgaaggcacaaaattatgcacccaatttcttcacatctgagcaacaaagggaagcattttccggagtccctgatccctagggcaaggtttaagaacaaggctggggccacatcctggtgccctgtcaggctctgagccggggccacgaggattctggtagattctgcatgcacagccctggtgggccctggctccctgccattacattcgagtcctctgcctggggtctctgaggtggtgagtggcacccacagtcgacactaaatctcagccccgctgaggggtctacctggaacctggctgcccatcaaggagttgacagagctgtgctgacctaggtgggtaggtggtagcctacccggtccttgccctgccactgactggtgcacccctcagggacagaccctaggaaagggcctggctgggcctggagggcttggtggcacagcctggctcgagttttctccgttatcagtgcagccatcgggaccgtaaataccccaagcgcaatcctgctgacttcgggaagtaggggcaggaaatccagcagccgcccggccctcggaggcccagcaggcgtgcagcggtgccaatgcccgccggccctgccaaccccagccagagcccctggccttccctaccagcaccctcccccacctcatcccgctggtctggctgcctgccggaagggagtcaaggccccagcctccaactgttttctcagctcagctcagcccctcagctgggctgtgcagtgagtcccaccccaggccagcttgcctagccataggatgagaggtctccgggatgcacagctggctggcacccctccagggaggcctagagtgtccccctgcagggagttcaccagtgcaggccagctgagcttgttcagggctgcctcagtttccctggcagggagccctcttcttccttggtgtcctggccagggacccacattggagagaggggtctgggggtctcccttctcgtcacagtcctgcgggctcgtcaaaactcttgcttgacagtgcagtgtctgctccaacacagacctcccaactaccttgcaggacgtccccattccagggatcccttccacccctgtgcctgtcctggtggcttaggttctgcctcactccagggtgtggagagcagaaacccacccacacccgcagatccaggggcctcctcacagcgagtctacttcctgcgggcctccctcccctgtcaaatgagagggtttgactcctgcttgtgtccttagggtcaaaagtcacaaaagctgcctcatgccctttctgttttcatcttagattattgtcttctttatcctggagaggactcttatttgctcaaatgcccacataaatcctcttttacagatggggaaaccgaggctcagagaggctgagtggtcgcctgaggtcacacagctagttaggtgaagagctggtcccaaggaggacacagacaggggtgggagatgaggtagagagagcaaggaggggtttcatatcacccaaagtccgtatggagaggctgaggagggttgaggccaggggcaggctgggggcaccagcagcagggcccagggccttcagtgtgggccagggaccaatgcaggcggtcgggagaggtccggagagagctggccctgcccactccccctctggccccactgggcttcctgaagtcccacacagggctggcagtctgtgtgggggctgcataccccagacattctgaggaatcgatggcagaggccgctccagccctcctcccccagcaagtattcttagcttggtctccaggacctgccacactgtttacgttgggccctgtttattttgcaagctaagctcatactgcttttgctgatatgaggagcacagtgggctgggagagtttctttcttctctgtttttgccggaaatgttcatggctgagagccggacacaggggagtcctgggtttccatgccgcagttcagaaagcgttgggcgggaaggggcccccaccacctgacactcctttcactgcctccggtcgcagaatccaggcctccaggatgagaatgccccccaacccaggactcccaaaaccacaccctgcccatgcctttaccaagcttcgtgcatgaccccaacctccaggatgcaggcaggcccagcctcccagaattgggtgtttgcccccagacactgctaccctttccctcattccagtgtgactcctccatcaaccaggccacaagctggaccccaaggcttttttgtcttgggcagttccccgagctgcacccccagagccgccgtgctgctgttcatcctctccctttagcccaacccctgctgagttcaggcctttatcatctcttacttggattatttttccagccatatatgcggtctccggcctctcctcacacccaccaatccttcacattgtatattatttcttaaacactgctgaaatctcacttactaatatttaatatatcagaatttttgtgccagtatttatgtgtgagatacatacatgacataattttcctgtcttgtatggtcttcatcaggctttggtgtcaaatgtatgtgagcctcacagactaacttaagaagtgttccctcttttcctatattgggatattttgtataagattagaattttattttcctcaaatgtttggtggaatttaaaggtaaagacatctaggcctggtgttttctttgtgggaagattcatcattcctgattcaatcgctctaataattatggactgttcaggttttctatttcttcttgtatcagttttgataagttatatattctaggaatttatacatttcattttagtttccatgttcattggcatttattataattttaatgtccgtccattagcatttagtcccattttttattctcaatattatttatttgtgccttcactgttttcccccttagtggtcaaacttgacactattcccctgtcttattaaatgtttcgtggacttctggctttgctgatcctctctattgtgattttgttttgtttcattcacttctgtttattttattccttctatttacttggccttaatatactgttctttctctaacctctctaaattaagaagaggataattcttaattttcaggcttcctaaatttccttttcgttttaatttttctaaccactgtcaatctcatggctttctaaatttttaaggtatgcatttaaggttataaatttttcctttaaatatcatccaaactacatctcccacattttgatatatggcatttaattttaatcttcattcactttagtatttttctaatctccattatgatctcttgtttatcctaggagttctgtagcaatgtggtttttgtcattgttataattgtagcacagctttctcataatgttgccctcttgtcagagaaagcaatccatatgatattaatcctttagaatgttttgaaatatgatttacggcaaaaatgtggtcaatttttgtaaatgtgccttctgtacttgaaaacaaggtatattctgacattgttgggtgcagtgttatgttcatatccactggaacaagcttgttagttggtctgttcaaatcttctatattctcattggaatgtttttatctgcttgatctattattactgagaaggcatagggcaaatttctgtttaactttctaagaaacttctaaactgtttccaaaggatttataccattttgctttctcaccagtaaagtataaaggttccactttctccacagccttgcaaatacatggtcttttctattttagcccttttagtgagtatgtaatggtatctcattgtggttttgatttgcatttccctaatgactaatgatgttgagccacttttcatgtgcttattagccattcatagtcttctttggtgaaatgtttattcaactctcttgcccattttctaattaagtagtctgttctattattgagttgcaagggttttttatatgttctggatacaagtcctttatcagatctatgacttgcaaatattttctcccattctgtggctgtcttttcatttccttaatcacatcttttaaatcacaaaagtttttaattttaatgaagtccaatttgtcttttcttatatggctcaggcttttgatgttttatctaagaactctgcctaatccaaagccataaacattttctcctgttttgttttgggtttttttccttctagaagttgtatagaattagctcttacatttcggtctatatttactttgaggtaattttggggtatgatatgaagtaaagtctagatttgttttgttttattcttacttatggatatccaattgccccagaacatttgttgaaaataccccatttcctcctttgaattatcatggcttcttggtcaaaaatcaattgaccataaatttataggtttatttctggattttcaattctattatgttggtctatatgcctttctgtaagtctatatgcctttctgtaaacccatactatactgtcttgattattgtaggtttacagtaagttttaaaattaaattatgtaagttttctaattttgttcatctttttacaaattgtttctgtctattctaagtcctatgaatttccatataaattttaggttcaacctgtcaattaaaaaagaagggcctgctgggattttgataggcattgtgttgaatctatagatccatttggggaaaattgacaacttaacaaaattgagtattgtaatcaatgaacatggtatatccctccatttatttgatctactttaatttctttcagtgatattttgcagtttggggcatataaatttggtacttcttttgttacatttactcctaaatattttatttgtcatgctagtgttaatggaattgttttcttaatttcattttgaattaattgttcattactagtatatagaagtaacattaaatttttatatcaatcttgtaaactgacttttctattcttggctttagccatttttgttgttgctattgatttcttaagattttctacatataggatcatgtcttgtggcaataaagacaatttttacttctttccagtcagatgcctttaatttctttgttttgcctaattgcactggcttgaacttcaaaaaaaatattgactagaagtgctagagcagatcttctggggaaaatcattcaatcaatttccattagctctgagttttccatagatgccttttatcatgttgagaatatttccttctatttttagtgtgttgagagctctcattatgaatggatattggattttgtcaaatgctctttctgtgtctagtgagatggtcctgtggtttttattccttattctactgatttggtataatacattaattttcaggtgttaaaccaatctcacatttctggaatatatcctacctgggcatgatatataatcctttttatatgatgctggatttggtttgctaatattttgttaagaatgtttgtgtcttcaacctaggaaagctgattgaaagaaaaaaaaaagaatgtactttatattcataaaggatactggtgtggttttcttttctgactttgatgtcagatttttaaatccttttctttttaatcctacaaccgtaggatttcaggtttgtcttttgtaaacactgtattactgagtttttaaaaaatcatttaatacatttatatttaatacatttatatttaatataatttctaatagatttggattgaattctagcagtgtattttgtgctttccacttgtactaaatctgtaatatttatttttctcctctttcttgcctctcattagattattacttctcattctacttttctctctactggttttgaagttatgtattctactaccatccttggaaaggttaacctagaacattttaaatgaatatatatcagaagtaattgctatatctacccatatctgtaataaaatagggatcctagaacactttaacttcaattattctccccctgacttagtactttgctgttgtatattttagttgaactgtgtttaatttttaactcactaattggtagtgttttatacaatcaatatttgtttaaatttactcacccatttgcctctttgtcatttgttatttcttttttatctcagatcttacatctgggattacctttttatgtgactgagggattcatttaaattttcttcagtgaaaaactctcagattttgtccgcaaatgaccattttactgtcatgttaaaaaatatttccaccaattataaaattataggccttaggttatcaaaattcttttttcttagcacattaaaaatgttattgaactatcctttggcttccactgttaccgttgagaatgaagatgatgaattgttgctccttggaagacaatctgtcttttttctctggctgcctttaagatctttcctttgactctagtctgcattttcactaggatatgttaataggtttctttttttctgcctgagctaccttactcagtggtttggtgtctttcatcagttctagattattctcagttaatacttcgtaagatttcacttcagtctcattatctccttctgaaatttttattggccagtagtagaccacctcactccccttcatatctcttaaccttttttttttttaaatcactttgtctctctgtactgtattctggaatccatcttccagttcactagttgtttctttgactgtgtttaatctgctgttaaaactgttcagtgaattttaaacttcaattattattattttatttataaaagttctgttgggttcttattcatatctgataagtcattttaatcgtatcttcctctttacttgcctgttcaaactttaaaattttcttgaagtgtattaaatatggctattctatattgagcttctcttaattccagtatctaaagtatttctgagttcacctccctgtttgattttttcttctgctgactctcattcatggtgtttcatttcgtttctgttttttttttttttttcattgtaaacttatatatcttaaaatttatctgtgggaatttttgaagtctggtgtgaagttggggtcctcagggaggaatcatgtttaccccttccattgccacatatgtgggtgtactgccagcctggacttttaattctaggctcaaagttttctaggccacttaggtagtatgaattcaagcctccaagctgagcatggactaacttgtgaacatgactttccaggacagaacttgttctccttctcttagcagtaatgcagttttctttacaatcttctcagggagtaggagatttttcattggccctcacaatgaaagcagagccctttgagggtcccagctttgtgtaagtctctgctatgagacttcctggggcaggcctgggctttgacacataatcatctattcctggtgaaaccaaagctcaagttcatctcactcatcaaataccttcagggcccctattacctctggggttccactttcactgagttttcagcctctaacctcccttacttcctggtcagctcatccatgctagccacagatatcattttaaattttctaatagccacttttttaatttaaaagaaataagtaaaattgattacaataatatattttatttaacccaatagatccaaaatatcatttcaatatataattaatatttttaaaactcttaaaattgttgacattcttctttttcatactgggtcttcaaaagccactgcatattttacacatttcaatttagacaccgagttttcatgagaacgacttggtctgtatttagatttcataaaatttaccattgaaaaaggagattcccatgcctaagtcatttcaaacatactgaagggttttctaataaccgaatgaaggatctatctttaaattttaattttaatttattaaaatgaaaattccattcctggatctcagtcaccacttttttaagtgctgtgccacacagattcagctatgggacagcgctgctttggacgggcatggccgtgcgcgcgtgtggggaggtgagtgtggctcccccaacgtttacccaggccagccccaaggaaatgctcagtgagtgcccatagaatgtggtgaatgtggatggcagggaccatacgggagagcacactccagtagttgccatctcatggccccagcgcccctctccaccccatgcccccaacagagatgcatccctgcagacccctcctgggctccttctccacagcatcctccccaagttcccctgcctcgagtccccagagctcatgacccacgcctccccgaggtccctaaggaatgtccgcttgggattctggttcttttccggttctctgcagccaggtctgttccctggcgtagcttcgcaactggaaggtgctgctcagcagactgtgagaagtgtgtgtcggtgcaggcaggacacacttccaggctgtcccagaggccagggagcaccttgccactgaagggctggttgcatcagaaagttaggcagcctggactgccctggcagccccagacctgcctctcctcggcagctccccctcccctctgcaccaccccccgccccccacacccaacccaacactcctctctctgctgctgggctgctcttgagtgacagggccgtaaataggcaaaggcgggggctctgactgatcaaagggctccctttagaagccgtcattagtttgctattctgggaactggttattttaaggttagtgtattttttctttcctgaggagccgtcttagtggatggcggagtccggaggggctgcccttcagtcaaaccacacaagccctgttttgtctggggttccaaagataaacctataatgaaagcagcgtttgacgctgagcaccgccaccctgttcctgcacaggggtgggtgtgtctgccagggagtccctgtgcccagcaagctccggggaggcttgcaggaggcccctggggccaggttgagtctgctcccagggagcctgaggtgggaggtcttcagacctggcattctcacagccatcatggcttgcctggccagggaccgaggccccgtaccctcccccaacttcaggctacccccaaaggccacccctggaaccaggctcagcaggcacctctgaaccgcagcccagctctgcccagcaccttctttggaaagacagtggacccaccagtggccaggggaatgcacacccctaaagtcaaaatgtaaggaaatgatgataccctgtgctggcatgggtgcggaagagcagacgctcttctgtcttactaggaggtgggaattaatgaaagtaacaactcctggaagggactctagcactgcctgtgaaaactagaaacccgtcatcactcctaggaaagaaaagcaccagggtcgggctttgcatgcaagctttgtcatgtgacaagctcaaagccatctgtttgtccatagagaagcgtggtatatactgagacacctcgacgccgcagccccagtgcccgccacagacgagcttttgccggcagtcattgctcgggagggatattattgatgtgttgctcagtaagaaaccaaagttgccaaggaacgtgatcgcatctctgtgcagccacagcacccaggacgcagctgggaagggaggccaggggacagctgcgctccgggatgctggggccgtcggcctcccccttcccaggcccagctcctgggcactgggaccaccgtgggcttggctctgagatccaccatgagttctcgctttgtccaagattgagatgcgccaggtagttggtgtgctcatttcgaggtgtttctttttccccccagtaaagtgatgtcacgtggaggtgagtgtgatgggaaagggaacctcagaaacaaggtcccaccttggtcctctggtctcccctgggaggaccacccccaatcctaacatcctgtgaggtcctccccactcagaggctcctctctgtgccacccatcctcggataggttgccatgaggttgccagaggctggcaaagggcacttgtcagctgcagattccagccctgccctgggacttggaggggatcatatccctttgaccaccaggtcatgacccccagatcatatcccaatgaccctctgccataccatgagcccaaatgaccctcaacctgccacagagacagcccccactaactgccactgggtgatgggaccgtggagagtgcccagctcagaggagaagcctgtctgatgtggctcccgtcctcctctgctggggttgtctacactgtccccactcggtgacaccaggagctggcattgcctctggttctactgctctggacagccctggcagcagtgccctagcctggcccagcacctactgagacagccgggccaagccccatcctgcaggtgcagtctcactttgtcactcttggttacccatgggaccctgaaccccataggaggggctcatcactcagggtcctcatccaggtgtggcccatccacacccagcatccagctgtgcacacagggccacacacagacccctttcccatccccccttcccatcccacacagggcaaaagcctgacctcctctcacgcctttggagccagtggctggggtgcaagctctgccccctacacgcgatggctgtgagactcggcgagtcacgtgggctctcagcgcctcagcctcctggcccccagtggaggggacaggcaccattatgccgatcgctcgcgtgcaaaggccctgtggcgtgggcagtgtcacaagctcctggcccaggaggcctgcttggctgatggcagagctcagagggtgtgagcatgaggatggcatcaggggtctctctgcaagttcaagttccgcctcaaccctactacgtggccctggccaggcctcctgaatccaggtcttgctttccccagctatccagcggcttcctgcttctcttaccctcagcaatcccccaagaactgttcttttccccacactagcgtctctctttcttggggtgtttctctcttagcctgcctgtgggggacagttgccaccctcaagcctctcctgaatgactctatttataggcctccaatattggccagagaggaaatttaagtctttttaaaaattcagctcaagtgtgtgtcaacttctgtgagtgcaactgcttcagagagaggctgggataggacagcaggcggcaggggcgtgtcaggtgcccgagcaggacggtggccggagcccgcagcggccgagccctcactgggcaccgtgtgcggatctataatcgacagcatcaattgcgggagtccggctgggctggccgcctgcaggggccagggcgtgagggcggtgcggagccttgtctgtgcggcaaaccctgcctggctgccctggccaacctcagaaaaacatgtattttggtcaaaatgggccccttttcaaacttgtcaccccgtgggtcagggcacagcctgcccccagccggttctgcatattaagcagtggcttggtcaccatcaaaaatagatgtcccgacccgagcctcccctccctcccggggaggggacctggccgtgccggctgggctgggaaaccgcgggcggggaaggaaggacggggcgaaccggcggcacaggcccagcacgtcccgggccctccccgtcaggtgtggaccccgaggttgtgcgggggcttggcggcagctgcgggtgggggtggggggcccgggcctcccgggctcgggttctggccccaggtcagaggtggcgctggcggcaggtggatgcccaggtcctcgccgcgccgctccgggcggtgggaccggcttcctgccctggctccgagcccgcaggtgggggcttccgcctcactttggacggtggcgtccacaaaatggctgacgcggcgcacggccgtccctgcacggagccggtgtttactttgccgcgcgaacagcctttcgttgcccgggttccgagtgctccagaggcagatggaaatttttgtggattaaacacggggccgaggcgcgctgggctgtttgggttggcaacctgagccctccccaccccgttccgcgtccgctgcttcccgccctggtccggcgcttccattcatgccttcccgggtccctccgccacccctgcaggcccggcgtcccctcccgcactcccgcggcctccagggggtggccctgcaggcccagagcagcgtgggcctgaacccctctccacgtgtggaagacgctgcagcaataggaaggggctgctcctttgagggcccttctcaaacctggagcccctctggccgccagatctttgtctgtgaaacagcagccagtgtgtggaccaggcaggagtggatggggtgtgtgcccacaagtccagcacccagaaaacccccagcacacggtcccttttacagtggcctctgctctcaggaaggtggaaagcgccaggtggataggagggacggggccgtgacccctccctctgcccaagagaaactctctccctcaggtcagacccaggcctttcaagaagaggttgcagggtgtgcgggctgccaggaaaaggtctgtgcgggtgagggagcgcatcctatggatatctagaggaagagcgttctgggcggagggcacagcggttgtggggtgcgggctgaggcagtgcctggaccaccttggcaacagcaggaggcactggccagagccacggacaagggggagcctgggggcgcagaccaccctgtgaggcctcaattagaggagatgggggcttggggccccggagggctgagatccagctcatggctttggcagcattgttcttgcacgttcaggattagccgagtaaggtgagcctgacagcggggccagcacgcagccccctgcccctcgccccctccctgcccccagtcccccacataggtgtcaaagtgcacagcaccccctctcttccccgccccccgggagccgcaggtcaggcacacaagagccatctgtgtgggcggcaaggtggctgcctgtctgctgcccgcaaagggatgcttgtccagcagggtgaacaccccgtcagggcaggagctgctgaggagatgctgatgcctgggtgactcatgctacctggccacccatcctcgctgggctacaaatgggttcagcctcatgggcatcaggcagggcccgcctgggtgcacccgacaaacacaagggctcttgttctaaggctctgtgatagcccctcttactgagagggaccatatccaataacgggtggaaattgcactagcagggtcatgtgagggctccgagctttctccagaacccaggaatatcctcaaaactgaggctgggcacagtggctcacacctgtaatcccagctctttaggaggccaagacggggggatggcttgaggccaggagttcacgaccaccctgggcaacatagcgagaccctgtctctatgaaaataaaaataaaaaattagccaagcgtgatggtgtgtgcctgtggtcccggctgctcagcaggctgagttagaagaatcgcttgagcccaggagttcaaggctgcagtgagccatgatcacaccactgcactctagcctgggcaacacagtgagatcctatctctaaaaataaaagtaagaagtattttttttttaactgaggcccttctggagggatggagggaccagaagtcacaaggagcagaaaggaaaaaagcaaaggaatccttctgaagcactgtgggcatttattcattcaccttgtgccactgcctggggctgcagtgtgagtagggtgggctggcccctgctccttagaatgtacagccccatggctgggcagggggacgcacatagtgacccgtaattacatatctgtctgtgtgaaggagaaagtactcggttttcccagtcagtggagtcaggagcccagagccaaccaggagtgagtgaggaggaggagggtgacacagggtggaagagtgtccagtgtgtgcagccttgcaaaggccctagggcacgagggcacatcctcctgaggccatgagagcaggtgaggcagagctggtgagcgagggatggcccggccgggccaaggatccaggggtggctccggcttcgtgggaggagggttacaggcaggtgaggatgcagttccaggagtggtgaggggctgctgtgggatgagggagagcatcagcactttggactagggtggaggccttggggccagcccccagtctgccagccccaccgatgagaacaagcagactgaggggagaaaggttggagaaggaccccgagcttctgctgtgagcccccacgtggggatgctttgctcggaggggtgctgaggtaggagggtcaggagggtctggagctgtatttggacttggcaggcaaccaaaaccccagtgcttagagatcaagtggaaaagaaaagaggaagaagatgggggagtgagagagatgggaaggcagtgagggaagccttggggaggccgtggtcaggggcggcacaggggagaagcaggctcatgtgactcagccctgagcccagccgggcccccaaagatgctggaccttaaagacacaaagatgtgatgcatgtgtgttcacagattagcggggagcagatgccgcatggaggggcgtcagggagtacaccgccttcccaggtgagggtgtcctggaggaggcacaagttctgctgggctggactggacccagcaagagagcctgagcctggaggacccctctggcccccatctcccactttcagcttcagctctgaagccaccacccagaaccacatacctgttcttcccaagtttgctctccctagcggagggaaagacgggaggtccacagattaccttgtctcttgaaagcaagatgccaccagtggggaccaatgtacagagaccaggcccagcctagagtgggtatagctcatcacacccccagaagctgtgcggggaggaaggcaagcaggcagcacagtcaagacctgagtttgatgactcagagggtcctctgcctgtggttggcgggggtccaaggggtcttcccatctaactcgccacctcctcccacgtcccactcagctccaccccacagcagccaagaagccagggcatcacttgaccttccgctgcgtcagtctccgcatctcgcctcccctacccccgacctctcgggtgctgtagggatgaggtaggagtggtggctatgaactggaggccttcgcctcgggctggagctcagagcagtccctgctgctgccagacctgcagttggggcactgcacccatgtctggggaggccacggacagggccccagggtctcaggtgacctgtcttgtgtatcccacttcgtttctctctttccctaaaggtgaagttctggagcaaaaagagcctgagctgtgagccgaggggctcctcctcctccaaactgacacccagtcacagagcaattgctaaagacacagtcatgcttgggcccagagtgggccccacggagcttcccccaacccagcctggcttgagcaggcccctgatctaaaccaccctaccccacacccactggggctcacctggggtttggccagcatccctagaaatcagaagcccgcccctaattctgccagcttctggctttccgttgccatggtgacacccagcccccagctacagatcccgccaactcttccctgccattttgcaagaaacaatatttttctgctccacaaacttggcgggaccctgcctttccccgggtccatgaggaaccccacgggttccttgccctggagtctctccagctctcatcccctgagtgcctccacaagcaggggtcccatggggcgggggccgggggaacagggggtaagtgtggccaaccccttgcacagggcttggagatggaggcccctccccaggtgagaccggcctttggccccctgccccactcacacagggacaccctttgtgtttttccacatctgagagccaccgacatttcttagatgacgttttcttgaacccaccgtgcttggtgcccgttaagtacttctactgcagcagcctagaaccgacacgtgtgaaaccattggcttatggcgcaatgcacttcctcccggcatgcatgaaaacataaatgtaaataccaaaatacacagggactattcggacaccacctgaaatcattccatgtcccaccagaagccagcacggcccctggccccctgccaggtgacgctgccccatggcagccacagtgctgatgaagctctgtttgagatcaccgcctggctaaggccaaggcggccacgtcagttctcacggctcctcccaaactgaggagcatggaggaccctgggcattgatggcagggtggcaggaagcacccatcgctttcctctcccggatcttcccagcacccttccaccttcagcctttataccccgagaccaggcgaggcctcccactgccgacccaggcctatcatggggcctgagaagtagtcctcatttcctcactctcacaccccgacacaccctctccatggggaaggaaaacgtgccccgaaggggcctgtgtccaggttcctgcccactcagcccctcggggccgtgtctccctgcgtcagagctgggcctgaagataatgggcccactgaggtgcaggcggtggacagacccaggaagacctcgtgggtttcccaggaagacagagactgggagccattcttcccggcggcagcggctctcggcctgtccttgtccccacacaagcccccactgctgcgccgtccctcctgcgccacctgacagatgtggcggtgagaaaacgatggggcagggaaacgttcgccattcggtgccaataaaggccgcctttatcccgaccgtaaatggtttctgtgtggagtgagactgtgcctgtcccgggcctaaccccccaagggccagagaggcgaaattagatccgtggggagagattttacaacgtatgggctggtggcaagtggcggcaaaccgtccccacggggccacaacggggcattgttcacggcctcacctgggctgtctccagcaccccaggatttacgaggactcggcccagagcctcgatgccggccgctccgggcagacctgggggggtggcgggggggaggccctgtgaagaggaggacagtgctgggggctgggccacggagaggccgggcagcgctggccccagcccccagctcccagctccccagagacagccagccaggaacgggccccaacctgcctgcagaccaagcggtcacatcgcgaatgagtcctcatgctgtgcgtcccccactgggcagccagaggtgtgcctgacggggccaggaggctgaagacaacctttccttgggctctcagcgatgccagctccagctgctgtgtcatcaaggtcgggctgggctggcctcttcctagcagaccttccaaaaccccgcagactcccgtggctgtaccagccctgcacctcctggccacctgcccctgcgtacccaccacccttgctccggagctcgagggccctttccccactagcatctgaccgccttcttgtatgtcttgaaggttctttgccttctctgtgcagcagggccctttacagtgtagtctggcccctcctcctcccccgggccccgtacttcctccattctgccccttctcaggtgtgcgggacctttttacagccccctgcttgtgcctgcactccctcccctgggagcctgcctcaccctgaccacatggccttcggcacccagcttgagtgtcccatcctgtgaagccagccggttcccccaggcacaggggatacctcttccctttgggcacctgccctgcgtactgtgccagcctccaggttggcccaggcagcccaggctgctcagggtcatggccaacccagggcaccgcggtgggcagatgcagcccctttccaggccaagttcagccctctcaccctcacaggggacccaattgcacagccatccacagcggccttgggacaatactgagtcttgagttaggggtgtctctcctcaaccctgagagcagccccttttcccaccctcagtgcccccacttgtggcccaggcccaagcaagcctgcatggtgcaaacccacatggcagcccagggcccaggaatggctgtccaagaggaaggggctggaccgtccacgccctgggttcccaaccacccttcccctcctggtcacctttcggcttggcatcaggagggcttgaagaagactcctcagccccacctgcagacctagctagttgccaaccacctggggttgtgcccagtcctcagaactcacctgcccatggtcatctgagccgttcccacaaaagccttccttgggatcctcagccgtctggggggcctccttactggggtcacctcaaaaacagctgtagaggggtttgcggcagcagcagcagacgtttttaaactaattcattggtgatggcaaaattatgccgagttccctgaaaaaaaaaaaaaatacccactctatttcctcattaacataattgcaaacagaacgaattttcttgatttcgtgtaaacaacagcttgaaatagtttataatccttgcaggtatcaaattaagttcttacttatggtctggaaattaattacccttgcagcgagacaaatgtgaaaactgtgtatttttgacaagaaaatgaagcagctattggggaaaatgtaacttaatcgtagcagagaaaattgtttataaattggtcgcgttgtttgaactctcgcctctgtggctcagggctgggttgatctatgcatgtacatttgcctaatttgggacaggggaaggggctggaggagcaggaacaggacgggggaaggagaggaagaagaggaaggagagcagagggtacccgcgtgaagggtacccacgaggaaggggacattagacaagaatgcaggtggtcaggcggcacttacctggcaggtgaaatctaaacaggcaccttcaaaggaggacaaagcagctcccttgggtaactaggaagaggacaccagctggcgaggggcaaagcaaaggacctgggacaggcacgtgcctggaacagaaagggagccagtgtgtctgcatcaaagtgagtgagagagcagcgcaggagagaaactctcagaggcaggcaggggccggaccacgggggcggtggtgctcagattccatgtggctgtccatccatggtgggccaggaggtcactgttgtggtgacaaccagcgctctttggaatggactgaagtggaatgtgatgtttaacttctgtagctgtaagttcgagtgtgtgtgtgtgtgtgtgtgtgtgtggtgtggtgtgtagcatgcttgcatgcctggacacagtgtgtgttggcatgtgtggtgtggtgtgtttgtatgtgagggcagtgtgtgtgttttgttgtatgtggtgtgtcttctacgtgtgagtgtggtgtgtgttgtgtctgcatgtatcgtgtgtgtggtgtttgtgtgtgtgagtgtggtgtgtatatgttgtatccaagacagccaaagggaagttccaaggggctcgtgcactcggtgtccagggagcagcatctgtgctgtctgcaggtagtcaccgttctccatcctgttacagcaaataccctcctctgcatttttcccttgtgtttgatttgccaggagcagaatttctgggttggaatcgggaacatttagaggagcttctcagtagagttgtacagagtggaaatgagtcggcaggctgcatggggggttccagtcacagcacagagggtgtgtgttttcggtgcctgccctcctgagctccaagtgtcccacgcctgcccgtcagtcctcatgtctacctgggcgaccccattttgaagatgcagaactgaggtccggagaggcctgggtagctgcctaagggtggggtagaagcatggtgccggctcagccaccctcaggtctccaggctcccagccaagggctccgataaggctgctgggacctgggggctgtgagcagatgcagacgtccacagttcccagggctctgaccctgccctgtctccagagcccacagccccacccaaaaggccaggaggtcacagatctgggatcctttcccgccaccttcaagaagggaataaagccacttcctgctccatcccagtggcctgagggtgtgggagggacagaggcctcccccagcagggtaaccctgcaaagagggggctgacagccgttcctgcttcctactgggcagaggctatagaggaggtttccagcgcctcagtgcaggcagctgagcccagacccctgggctgtccttggaaccactcccagcccctgccagctttgtagcctctttcttccccaccccacttgcctcacctcggcccaaacctgggtactcccagctgcagccctccccactttgcctgctctgaggctgtgtagggcccagggagtgggggaaggggcctgggtcccgcacaggattgaggtggcgtttacagaaccgggggccagagcagctgtggccgtgaaggttccaagcttgaagtggaaagggttttgatgccaaggtccaacgcccagcttatcattgtgtaaatctgggcaccacacatagcctctctgtgactcagtttcttcaaccctaaaatggggacatgcttgcgggggttcaggagatccccattgagcacggagaagagcaggtgctgtccactcagtgaccatctgccgtcaccattccccaagttatgggagaattcagctatggtaagagcagagaacaggatggcgctggggcaggaggagaaggtgtggctggcaggcactcatgaggacagggtctcagagcccattctagagaatgttccagaaggcatggggaggcaggagaccaggtgtgcccagggtggggacactggtaatgggaggtgccagagctggtgacagaagcaatggaggtgggtgcagggctggggcagggccaggcagtggctcctggggtgctggtggcccagacagactagagatggtggaagggtagagtgcagtcaggtttggagtgggtccactctttgcacagaccagccccctagaggctccccagttccaacaggatactgggctccatggctgtcacgtggagctgtctgtaggtggactggcttctgacccactcggggtgccggaccctgccctgtgcctgtaggggcgggcactcacctgcccttgcagtcccctctagctctccagcttcctgctggccagtcgtatcagctggctcagcagcaaaggcttcagaccaggggacttaggtgagagaaatttattcctcacagttctggaggctggaagtccgagagcaaggttgtggaagggtcggctcctggtgagggccctcttcctggctcataggctgggcccttcctctgtgcttacacatccctggtgctgccgccttctcttgcaaagacgtgagtcctatgggaccaaggccctgccttcacagtctcctttaatatttatcacctcctaaaggcctcgtctccaaacacagtcacattggggattagggcttcaacatgtgaatttaggagggcacagttcagttcataacacaagtcctccgtcgggccactggagcctggggagatgcccccactgcatgctgaagggcaggaagtgagggaggggagagcttgttgcgggggtgtccttgcctctcagggccacgcccactgcctgcgccagggaagaccagcagtgacagggatggtgtccccgcagcccctgggttaacactgcctcctcccttgctcttcttggcagcacagacctcagaaggctggagccccgggcaggcccaagcacagaaaaagccagagcagggtctggggtctttgcctccagtagggtgttgggggagctttgtattctctgtggctggaggcgatttcgccagctgcggagcggggcgcggtgggcacattcacccagactcacaccggcccaggacgtgctgagggtgttggggcccatccaccctccactccgcttttccaggggtcaggcagggggaggccacagggtgcccagcttcagccacacccgccttctgacaatgcgaagcccacctggtctgtgagctgtcgcctctgtcctcacagtgacagagctggctttgagggcagcaggacaggggtttagccctggctccggccctgtcgccagccggcagcactggggccaccagcacagcctcccagccctcaccagtattaactgtcatcccaagggggccactgaggcagcggggagcctgccctggaatgtgccatcctcgggcgcaggcagcccttcatgggcctgcccaatgtctattaattaagccccctggagactccaggagctgggggccttggctcagtgccctctcataaagttctgctctctggggaccgtggctctggcagccaccctgcctctcaggagccagcctagtgcctcctgggtccccagggtatagggccagaccccaaggcttagtggcaagaggcccagcagatgctcattctcccggtcaaacccctagatgacactcactggggaacagaggggctgggtccaggaaggaggcgtttgcagggcggggttgtctcctgaagactgcgagctagaggggagaagccactgcatgctcccagcccttcacctcacagtcccggaatggggaagctgagtggccacccacccttggacgttccctgagcatttccccactcagagtccagaagcccccagccccagcagaccctacagcgctacctgcaaaggccagaccggccagccagggaggtgggctagacagtgccctggccaccacagggcaacccctcagctccacttcgccacccagaggagctggccctggccactctctcagagcaggaggtgacatgaagggaaggtggcaggatgggagtgcccatcagccggaaggccacgggagtcaatggtgaggggcagagtgagcaaggggctcagggtagcccagaaaacccagccgggcccccccccccacgggcacccaggaaccgccctggctttgctggaggacctgccatggctttgccagaagaccctgggactgtctggagcatcctcccaaggactcgcccctagtcaggaaaaaatagggccccggagtcagcaagggcttcctgggggcccaggtcagcctggacggtggcaggactcggcgaggtggggatggggcttggaggatgtggcagagttcccatggtgtgtgtagaatgatattccctccagaccacggtgccttctgggctctggagaatgcacctgtgttcccaggagctttaggggtacccaggtggtgtgatggggagcaggagccagttgttcccaaacctcgccctttctccctgcaggcactggcagagctgggggtgatggggcttcagtggagcccgccaggactggggacacaagcctaggcctgtaccgtctgcagccccatctccaggtcccggcctgccccagcctgcccacccccagcctgtcccccaaatgcccagggctgtggcctgcccagacttgccagggagctcctgtgcccttctttctcctggcctctcagaagcactccctgatcctctccccacttccctcctcccctctcatccccacctcgggcccaccagctcccaccctgctatgcccatggaccccagggtcagcttttatgcacactcaggtactcaggacaccccacaccagccattggatggggccgcctctgccacctgctccagccacctggcagatcccactcggctcacacagagccttggccagcatgtggccgcagccccaactgcagcggaaggtatcggggagtcgaaggcagaggggaaaggacgggatggcgggtgaaccacacggggaggagcctggagctccttctgcattttcttaggaagtgctgcagggacccactggattctctacagcgcccagtagcccattagaagatacagaggcagcaatattcacagggccagaaacaactgcagttcacccatgctgtgcaccagctcccacaccacccatgccacgtgcctgctctccaccgagccctgcaaatgcctcggcacatcagcaagcacaggcctcctgcaacgtcattttgcagaagggaaactgaggcacaaaatactccactgccaccaagtcacccaactcagtggtagagctgagatctgaatgcaggccgcctggtcaagcccatctgtgaactagaaccccgccgccctgggcagaaacaaggctgtattgacggtgctgggagagatgaggggagggagggatggaggccggaacagagccggctgctcccctcagagggctgggtgtcaccccagttttgtctgtgggtttgtggagagcatcactgaaatttctaacttgacagagtggttccagggctcatatagaagcataaagaggtgaaaatagctgatatttctaaaggcaaaagctaacgagtggggttgcactgcccagcgtgaagctgcagccaccattctccacactctcctggcccttggcacaggatgagccttgcagacggaggcgacaccaaggccttcccctgcgcccacacccagcgtctggagctgctggaaatatgtgtccccaccatgaaactgatgctgctgttcatcccattttgtgtatgaggagactgaggcacgggcccacagttgccagctgggatttgtcccaggccacctggctcaggtcaccggaacatgtgacaacacatgtggtcagggagaggcagcaccacagtcagatacaatgctgacagggacggcagagttccacaggcaatgaggcccccggggtaaaaatgaagcagtttgaaaacaaaaccaggaagagtgtctggccatcccgggcctgagtttctgcccatgggcagctgccggacaagccctctggtgtgtcagcgggtcaggctgagccagacgtggagatgaggctgagagccggaagcaagggctttgtctctagaagacgcaggggtggttcacaggccgctggggacccaggtcacagagcctttcccccagctccagcctggctggggagagcaaaggctgcagctgcacagggcccctccctgcctgcccaaagctgctaccagacagcaagctggggagaaaactgcagccgacgacggagagggacgacattttgcaagtgaaaactcaaatctatgagaaaagcactcgccccgcagtaggaaagcaggcaaagaactagaaagacaatttacaaaaggatctgaaggtcctcactgcactcatcctgtaaggtggacttggggcctcatctggccccgctgcctgtttttgtaaataaagttttaatagcacatagccacgcccaccggtggacacatcgtccctggctaaccttacaccaccttggcagagttgagtcgttgtaacagagatcgtgtgaccaacgaagccagaacgatttactctctggccctttagagaaaagcgtgctagcccttgctctaagagtttcagtgaagagacgcaagatgcagaaatgaacctaattgtgtggtcttccgtgctggggaagccgaggagaaatggaagtatgagccggttccctgctccagaaatcgctctgatgacacgtatcacggggattaaaaaacattcctccccccttgacctcataatcctccttccaggattctctccctaaagaacaaatcagagttatgcacaaacaagctaatcacagccttatttataatagtgagaaattggaaacagaccgcatgtgcagcatttgcgggatgttggttcttgttatgcacattagggacaattatgcagctttcagtcatccctcagtgacccaggaaaatgccccatgtacaaggttactggagacaaacatggtcccagtttctggggtgggaggtggtgcccaaaacatcaccttacagaaaatgcccggaaacgtgtctctggagggtggacttagagatatgtttttgaaacagattttttcatatttttcaaaatttctcccgtaagtggttcttacctccataacagaaaaagagtaaacaatcaatgtggagtgaggaagaagagaggggagggagagaggaagggagggaggtacgcagggaggcagcaaggggacttccctgctgaggacgctagcccctccgtaatttgtctgtccttcccagcctgcctggggccacatgggccactgtgcccagtgaagcctggcttccttgtctgtggtgccagccatgtgggagggtaggcgacccgccttgggctgtgtaacgcaggcttgcctcttccttaccccggttgtgccagtggctaggcaccaggtaacctgtctgtgctccccaccgagcagctgggccgtgtctgctttccgaggaggctgcaggtaacccttctctaacctgctcagcccccagctccatcttccacctgtcctgggggatccccattcattctctccgtgggcatcatcagaggctcagctgtaccagaccactgcccgggagtacgttcgggctcaggtttcccttgagggtggcccccacctgacccctccccgcccctctcttgtgccctgagagaatagcgtgcccccagagacagtaaaagcctggcttgcgtgctggctccggtgacacacaaaggcctctgcttctccactctcaggccagcccgagagggacggcaccaccgggacagcaccagcgggggcatggggaggggtgacaggttgggcggggtccctggggctggggcgtagcccctctctgcaggccccacagtctgtgaccgtgcagggagggtgctgggagtctcggctctttcggaaggcgccagtgtttccttgtcacagaatgaagtaaatgggacgatgaaggggcagtgtttaaatggctgctttagcccgtttggaagtctgctaattattctcttgaggaaagaaatgcaggttcattattataatgagctttgggcaaaatatttcatcgagcctgacaagccgcagcgacgcctcgaacgtggccggctctgaaaggcctcctattctgctggaagctaattggcccggggtcttcccagccctgtgctgtttgtgtgctattttaattcgcttatgaaaagcccccgctttgatgtccgggaccagataaggccgggaggggaccctccatggagagcgggactgtgccgcccgcggtcgctgcactgggcctcctcgcccccccactccgggcccggggccagcgcgatgtcatgaggtaactgaacaaacagtcctgctgaaaaatatgcttttgtttcactaataaatccctcctcggaacactcccgggccgggccctcctcgggcccagcctaccaggccttcccgcccagtgcctccgcaacccgcgccaggacagccggcggtgggcacaggcgggcgaggggcacccccaccccctccagggccccccttccctcagcctcctccccacccacccgagctgcctgcctttcccgcactctcctccctgacttcctcccacctaccggcctcttccgacctctctctgcctctttcccccatcacgatactccagtggccaccttccctgcccaccatgcctcctggcccccaatccggtcaccaacttgaggctgcccctgacaagccctggctgcagcatgagggaagcagcggtagagaaggccaagtttgggcaccttgcacagcctcctggagcctcggtttccacatctgtaaggatgagacaggaacggtctctctgggggcagggccggtggtacctggagccctccccactgagcacctggcccagtgcccggcacgtggcaagtgaaggcggctgcttcccgcccctctcatggacaccactgtgggcaccacttgggcaccctgtgggcttattttccctgcccactgccaagcaccagaccaagatctgatgccatctgcccagggcattgagggtgaacccatccaggctggcccgccttccagccctcccccagcacccaccaagcccctgcgatatcccagtggaagataatggaggtgttacggggatgggctagaactcggtcctggcatcacagagctaccccggtcaaaaatataccatgtaattacagaccaggaaaattactgtgcaggagcaaagcagggcactgtgccggagaggaacaggggtggtcagggaagacctccgagggaggggcatttgaaaatagcattcagagttgctattaataggctctgatgcagaactgagcagagaagaaaacaaaagaggaccataatatctccacagagaactatcattaattttttaaatgggagtcctcaggtaggttggttgattgagtgattgattgattgataatcttggttctatttgaatttctagaaaattccaacagtacagaaaggtctgaaatgaaaggtaaataccttcatgaccatgccccctttccctaggataccccttgttatcctagaaatacccatccttagtgtgaggagagcagcattccagacgcttctctgtatgttgcatagaaaaaggatggttagatacatgggcagattaatggatggacagattgttgtatggaggattaggggagggataaatggatggatggatgaacacatggacaatgggtgggtagatgggtgaatagatgggtggacagatggaaggatggatggatatatggatgcatggagagacagagaaatagatgcagagatggagggagggagggaaggagggatggataaatggaggaatggaggaatggatggatggaggggtgggtaggtgggtgggtaggtgggtggccagacaatggatgtgtgagtgagtagatgaatgagtgggcagacagacagacacaccatcagaagcaaatataaatatggaatcaagggatgcctgcagcttttgaattgttgatttttttctttttttaagaagaaaccaaagtaaaacagaaggaattgctgaattcagataaatgtttcttcaccaaaagagaaattcatttctaaatgtcactttcaggttaaggaaaataaaatgtgggacgctggactcatcgtgggtttttgcggtcttctctcagctttgtgtggtagccagcgacgctgcaaccccgcccccgcagcctcctggtgcagcacgtgttcatttatgggttgttgttaccgtggcattggtccaggtttgtgatacttgtgcacagcttgggggctctgcttccctctgtttgttcgtcttggtgctgtgtatgaaggtggcaacagactccccatagtcctctcaccacagacacctcttctcagttcttcgtttccagttggactcatctcctgactggttgggtttctgcctcggtcgctgactccagagggccccacggctcatgcctgcttccctgctatcctcctgtgcactgttggcctttatcatctccaccacgtgctcaacactccaggccagagcccttctctcaaatcccctttggttctagccatgtttccctgagctcttccctctctgtctctaattgatgtgttttcctcccaaaccctccttccttgcataattctgcaactgaccttttttctggccatcctagattgggtttactgttccctggtactcagacctgcttaatgctcatttcttcagttttctggggaagcctcaggggccttactgataagaactgtgtggaaggtaagcattcaaagttcttacatggtgaaaatatcttcattcaaccatggtgccctattgatagtttaagtgggtatagaatttggagctgaatgtaattttccttcagaattttgaagacctcgtcctatggttttctagcatccagacttactattcagaagtcttatacttgctttagtctcatacttttgtaagtggcctttcttttcttcctggaaatgtttagtatctaccatctggactcaggggtttcaatttcccagagaagttccctgtggatggctttgttcattgactgttctgggcacttggtgggctctttggaaactttagtccttgagctctggaaaggtctctgtatgatttctcatcatggaggccaccatctctgttctctctttctgaaattccttttaagtcagactgaagacatttttaatgacactttgatgtctcaactttcttccccttttttatggcattatattcttaactttatctcttcagagttctaggaaatgtttttagcagtcctgtttttaatatcccagagcacacgcttgctctctgaccgtggtcatggcattccgccctcatttgatgggcacgacagctcctaggatctttctggagactccagatacatcttatatcttaagttctgcttaattccttgatcttctgtttatgtttggccagccaggcccctctctctcatgttctgaatgtttttcaatgtttgctcgggatctgtgcatggatgggcctgctggcatttaggatgtgttgacaatgactgggggaggtgcctgtcattacactgaggaaccccatatgttagagctctgaggctgctgcatctgagagcttgggctcgaggtacagggctggcagccgggagtcccacctgtaggacgctctgctgtggcagagggacaggacatggacctcatgctcagccccttcccatcgtcttggtgctgtgggcctgatgtgtgcctccacaaggactcccgccttcccagcatggcattcagagcagcagatggcttagactcacccccgcccagtcttggcacccttacagccccggcgagacccgggtgggcgtggaccctagcgtcccttcaccctcaggctgtgcacctccgcagtgccgtgtcctgtctggagcctgtcacacccctgtacagctaccccaatccaaatggagcctcccccaggaagcccctggtgggaatccgtccccacgacccctgtccggcttccctggctcattgtccctgttacaacccagatttcccttatcgcaactggtcctagcctgtgacctcctggggtggggaatcatctctgcaaacacagctcctccacccttatcagtgctttgtgaaggcagcagaacgttctcctgagccagtgtctgggtcacttgagcaatggctgccaagtccatgggcctgcacgcatgaggctgtgcctgtgtctgtgccgctggagaccttcttgaggttcactgccctaaaggccgcatgaggggacagaaggtgaacacagggccctgcttggtctgacaagcccaggcggggcccttgccgagcgtcagggtggctggcagccaccttctgtgatcgtcctccttctgggctgcggtctagggctgcacattcaggatggggatgtcccagtgggcgcgcagcacaagggtcagcagacccctggctggaggaggtcagtgtggggggctgcgtgggagacggtgcagcagtgggcctgggagctgagcaacggtggctgggatgggtggagaccaccaaagaggaggggccggcgaaagccaggcttcctgcaggctcaagcctggaaaacggtgctcagtgagcaacacattcccgttctacagtttcctgagctcccgagtgcccgccgcaggatgacagtgggacagtcctcacaggggcatgctcaggccctgccccaggcagaccccacgccctggcacgcagccccaccggctgtgccgcctctcgttcctgtcctcctggcaccgccggccacccctcagcccagccctcatggttctctaagccgccgcctcctcaggaagcctcccaggcacccatgctccctgcactgacccccagaccccagctttggccatgcactcccagacggctggtccccacacaaactttctgtttcaaggaacagaaacacccctgaaacttgtctaagaaggaaatgtgtcaactcacatacatgaaaagcctgagtccctcctcaaagtcctcccctccctccttctctctccttccttctttcccccttccctccttccctccctctctgcttccttctctccttcctccctgagacctgggacgccgaggagggttccgttccctcccccaccctggcagtgctcgggggctccagttgaaaatgatgggggacacatttgcatcacagcctgcccggccggctctgtggcccctgatcttcctactgcagcctctgccggggccggaagggcatttccgggaggcgggaacagcatgtatgaaggcagagctccttcccggagaggagggccagccccgtccccaggggctcccggctttctctctccccctacattcctgtctccatgcagcagccagagggactttaaaacataaaccagaccacagcactgcctgctcaagccccccatggcctccctcttccctaggaagcaatccaggcacccttccatggccgtgggccccacgcccccgaggccccacgcccccggggccccatgcctgcccttgcaacatccccttcctgactccacccagcctcctgggggcttccgcctcaaggcctctgtgcctgtgtgagtggcaccctggggttgtgccatggccagccctcaaaccatctgaagtctgctgttggcacctgccctctcctggctgcaaagctgccccctcatggcctcaggtctctgccccagcctccaatccctcattactgccccagcctgtgcctgtgcctggaggctgtggcctggctctccagctggaacagaagctctgagaagacagagctggccagcaccatctctcctgtgagaaccctgtgcctagaacggagcctggtacagaggaagaacccgacagactgtgagccctgtcttcctcttggcaccatgagtcacctgtcaaactgaggggctggcagagctggagggagttccatcccagccccaaggtgcctggagtagcttatggaggtcactgatggcctcaggatgccagcaggccctctgatgcccagggctcattcaagggcatctgccctgtgtcctcatgcacctccattcagggaacctgggctccccactctcacaggggtggagacctgcacctctttttcacccccaaacccgcctgcccgtcagtgcttagagcaaatgcccctcccccgccatcttttcatgactctcccccttcctcaaccctgcgcctggtcaccaagtcctgacaacacctccagcccctgtctctatggtcccctccttgatctggagccattcagccacatggagtatgtcctctgtcgagggggcagggactcaaaggatgagagaaggaacagaggggaggaccaacatctcggctgatcctggtctatttttagtcggtggtgggctgtcactccggaggccagtgactgcgtcatcagtgccttttgatcttgttgccgcaagatacacaggaggcagctgctcactgcttgtggaaagaatgagggcgggcacataggcctggggtgtggggagcattaatgagtgtgagtgagtggcggatgagtaggtagatggacggggagctgcagggagggagggttgcagaaagggatgcgtggaaggatggttgatggatggatggttagatggatgaagagatagatgaatggataaagaggtgaaaggatgaatagagagatggagggaaggagggctgaataaagaaatggatggatggatggatgatggatggatgggtgtgtgggtatgtggatggagagatggatgaatggttaaagaggtggatggatgaatggagagatggagggaaggagggatgaataaagggatgggtggataatggatggatgaatgggtaggtgggtgaatggatggatagatggttgagtgggggggtagatggagagatgcatgaatggatagaggtggatggataaatgcagagatagagggaaggagggctgaataaaggatggatggatggtgggatggatggatggatggatggatagatggatggatggatcgatgggtgtgtgggtgggtggagagatggatgaatggataaagaggtggatagataaatggagggaaggagagctgaataaaaggatggtgggtgggtggatggatggatggggaaatgaagagatgggtgggtggatggatggatgagtggtgaatgaatggatggatggggagatggagggaagggaaggctggataaagagacggctgggtgggtgagctgatggagaaatgatggataggtggatgggtagattgagaaatgatggataggtggatgggtagatggatggaaggagacaaggaaggaaggaaggaaggaaggaaggaaggaagggtggaggtaagggagggagggagagggagcaagcaggcttggatgagtagctaaagcacctcaagcaagggtgtctcccttagaaatacatgtgcctccaagtcctcgaggctggcatcccctcctgctccatctgcctctgcctgctgggcagaccagtctgctgtcctaccaaggcctaggtcttgactctggactcttccatgctcatcagagggtactgttggagcttcctggtcaggctgacccagctgcctctggagcctggcctgggatctggagagaaagcacctgtgcagacggccccagcgctatgcccttctgaggcctgctctgcacacacagctttcctcatcccggcctcatgcactgtgggcaggagttgtcctagcaaccatcatccaggcacctgctgcgtgctgagcaccatgctgggtgcttcctgtgctctcaacagccttatgtggtcagtaccaatccctccccaaattacccccatgctcagggtgtcactgagggtcccaagtctggggtggccaggtcacagcttgaacctgggcagcctttattctctaggggccttgggggtgtctaggctgccaccacagcatccacactccccactagagcccacataggtcttatgggtgccacagcagggaccccactggacctctgtgctttctggtggggggcttgtcagggagctcatgggcacctctgggttctaagaagctatgctgaggcccacagggtagttctgagttcgggggaccctctcctggccctgtggggtcggaggaggtcctgggagcccacctcctgtagatccaaacacctgatctcagctcaggatcgccactccagtgccccatcccagagcctttgagagtggggacagggtgtcctgttgtagttgccaagcccaagaaagatgaggcacccaggatgcctgacagtagagttgcaggggggcaggcaccatcgcccccagccccaggctgaccccagtccctccctatgcaggcagaggggcaattggaagaggctggagactattcaggagagggtgggagcagacacgggagtaggatgggggccctggaggtactgggtggagctgcccccagcccttcctgctggcctccccagagctccaggctctgaggccacaccctcacccaaggcaagttgctcagggggtctccaggctgtatctaacagctgcctgtgccgaaaaattaagcaccgctgagtcgccgcacacctgtcagggtggaggggacttgggggaccagccagctggatatgttcccttgcaggcgggcagggctctggggagtccaagtgtgcgcacagtcctgggtgagggctccgttagatgaatgtggacggctggcggccggggcttgggagatcaagaagtccctgaggaagaggacagtagccaggggcaagacctcacacgcctctgcccatcctgggaaactcaccatggcattgtggttgaagggtcagtggccaccagagagttcctgctgcagtgtggaaaagacaaacaggcgagtgaagtggataaagattcaggttgtgggagggagacttgaagggcaagttggccaagactaaaaagtggagtcaagctcagtgctggtgacgatgttggggagaggggcctccagcgccgtgggggagaatttcaagagccttttgtgaaaatggtcaggctgctgaaagtgagaccacactcaccctgtggtccagtgatctccttctgagaatccgccctggagcagtaacacccttgggactgagaatggcttctgggttgtgcgtcatcgctgtccaggagtggtgaaaagctggactctgactgcctgtcatccagagggagcaaacagccaccctgtggtgaagccacaccacatatgatgaggggctggaggcagcagaaagggggctataggaccctttgactcaagggctaaccatgatgtttcattaagggagaaatgcacttgctgctcctggaacattctggctcactcccgcctcaggcccactgccctggctggactccctgcactgaacgctcctcccagctcatgctttccaaagtcccctgctcaggaggccttccctgagcccctgccccctccatttcagacatctccatctgatgtctgagccctgaacagacacaggtgtctgttcagggctcctcaaatgcacaaatacatgtctgtgaccacagcccaacccctgggcagtggctgcccctctgcctctggaggtcccctccaaaaccttggtccctgtccgcagagggtgtcagggcttgaggtcaacagggaggtctcagggcaacagagcccagtggcactcctgaccccaggagacagagggaacccaccctcaccctagtccacatgcccgacccatgacccaggcctgtggcgccagcctgcacccggctctgctccacaggccaactctgcgcacgctcctttcaagggttaacggtgcaagctcctcacggcaccagtgcgcttgcctttgacatgaaaatgtttttgcagcaggctcggatgccagcatttttgtggttgcagtcagatgtttttaactacgttggacagaacccacggcggccctttccgtggcttcagccagtttctgagcgctaccttgaacccctgttgcaccccaggaggagaatcacaccagtgccccctgacccccagccttgtgcagacactgatacccttaggatgaagctgaccccagtcgtggcagccaccccagcagtcagggaaggacctgctggggcatttcagatcctgagcagcatgtaccctgtgaaagaacaggttccccaattttggttcatggtacctgagatgacggcttcagatgatgtccctggccagggaggtggaggacgctgggcagagccctgggcattaactcagggccatcacagaggtggtgagagctaccccgggtctggggactgttagcacagacctgagccgaggcccccttctcacaggggcctacccacttacgacccacctcctctcctccatggcaaaggtgatacattagactcaaagagacatgatatccccttgggctgcaacttaaattccaaggagagatcctgaatccagagtcacatgtatgttagaaacctctggcactctcccctccccagccagcacctaccagctttgcgcaaatgctccacatttgcattttaaaagccctgagaaggcctgcagtgaaaaaaactaacttcgtataacccaactattcccaaactctatctacaaaatatttttctcttttatcattaaagaatatgcattaacacctaaaacccactatcctggcaaaaaagtggcaggattgtctgaaaaacacatggccagccaccctgcaccctgagttccacaacatctaaacccagtgtctgctggccctcagagtgggagcgcgtgccccaacttccgagccctaggaaagggtcttgtctgctcttcccctcagtgtcaggtgacccaagagtgtgggggtcaggaatggcgtccttgtgcccttgtcacccactcctgtgggtacacagcttccctttctgcaaagtcacaccccaagccctggcttgagcatgtacacaggctgcagcccgtgttcctggagccaccgtcccaggtgtggctaaggcccccacagagtgtgcatcctaaggtggttcagaggtcctcagaaagtgccaagaggccttcctcagaggaagagcaagggtaggtgcctctggcatgagccagatgatgggagctgtcacaggactttgccacccggggtgaggggcctagaaacccctctccaccagatgccttacaccccccatccccacacgcacacagcttggaggctggaagcccccggaatgcggcccaccctgtctccagttgttccctaccagcccagctgctggtccctaaccgggcccacctgttgggtccttagcaccagctgcccagagcccccagcccctaccctagtctgatgacccaggcctttccccctgcccaggctagccttgtgctcagctgccagcacagcccccaccacacactccccaacaggtgtctccacaactgccaggagacagctcagcttagctgctcttcccccaacccccaggcccagcagaatcacatctaggagagtgggccacatgcctcttggaaggcaggtggcacaagaggttcatcccaccctccagcattacccagccccacaggacccacatcctgctcccagctccagcctgaaaggagctagtcctctccagcccctttgaaaagaccagctggacattctccagggagattctgccctacaggattagggagtaccctcacctggcctttgttcattggttcattcattcattcattcattcaacaagtatttgccaagcatccctatgctccaggcatcagtggtaggccagacagccaaagtccctcctcccaagggctgtggcccactaggaggacagacaatgacagagcattgtgtgctctatgcctgcccatgtgctgaggaaggagcaggagaggaagacaaaccagagtttaagtgaggagtgggcaaggcttttatgaggcccagcccaccctcccctgggcaagctggggatttgggaatgggagacatccaacacgtgtcagcccatacatgagggtagaagtccagttgaaaacacacctgaaacagcagggtccaaacaccaggtgccgagagccttcctgacattgaaccttccttgaattcctgaggtaaaccttatgtgatcttgactcaagtccagctgctgatgcatttttaggttttagcatctgtgttcatacctgatttgggcctagaattttcttgtgtttgcttgagcagttatggtgcctggggttttaccttgtcagataagttgagcaacctccccttttggctagtgctctgggatggatgggatggatgtcgtctgcttttttaggtaattatagaaatcacccccaaaaactagactggaaaccttttagaggagggtaggtaactggcatttgtgtctccccaatgggtttatgtttcttaggattttctaccacataagccacttttggtattttttgccttgaaacttatccatcatattgtgttttcaattttattgatatgaaagtatatatcataatcacttacaattattcaattccctcggtagcagtagtattcattcctaattcttatttgttactttatttgcttaaggtttatctactttactggctcttcaaacaacctgcatttggttttattggtcaattctttttcataaaatatttttctattttgctaatatcttcctttgactttgttcattcttttctttgtatttgttttggtgttctttttctagcttcttgagttgaaagcttagcacatttattttcaatcttttttattttctaaaattgccatcgatacttctccaaataccctataggaagcatcccacactcttggcatgtaatcagctccttgtaaatccatcctaagattttctctctgccttattttctctttaatcaaagagttatttagaagggtactttttaaacttcaagatgtatccatctgttgctatttttattaataattttctattttacatcaaggtacagatttttagaaatttatggagttttcctttggtgcctaataggatcatttctgtgacctttttgtatatgtgtggaggcggtggagtcttttctgttaattgtgttaaacttgttagtggagttctgcgactcctccacctcctgacttaccttgctgtttgtttgtttgtttgtttgtttgttagtttcacccactgtggtttgtcagtttctgagagacaggcactaggatggccaataatattgtggatttcttgatgtgttggttttgttcatttgtttttcctgccccatcctctgggcccttaaagcctgggcacatgtgtcctctccttacgtctggggaaatggtctccattgagggtttgagtctgcgtggcttccgcctcccttccctcctgctagagcccctctggaagctgctggaagccatgtcctccacatcccctggctcttccttcatcccatactttcttctccctgacagagctgtcaaggggagtgcctacaccccacctccattgctgctcaccctcccctggcccgtgctgggcctcggccatctctggggctgtttctaggcccatctaagcgaggggttccttaacctgccttgcttttgcagctgcctgaacctccctctaaggacatcagcactcttcggaggccaggtccggcctgctctgctgccttggtgggaagctttcgtccctgcagggtggggtgggtctgtcaagtgttcggtggcccctggctggtgctgtagcaacacgggtgtcagagggcggacaccgaagcctggtgctctgtgcgagtcccgtttcctcgcctctcagctgtgtgactccaggtgcagaggccccgcgtggggcaggagcactgcaagcgagaggatgggaaggtggccgtgggcctggcaagggttggggaatatggtgagaatggtgcccatggggtcacgccagccacacacactttctcgagaagtttcaagtggagccacagggccattgtgtgtcctgaatcattgctctggctgagggagtctggggacccatgagggccagatggatgggctcagatggagtgggaggccattgggaagtggctggtaaaaagcctcatgagggcagagccccactgaccccacacagttacccatggtgtccccttccccacgtggtaattctggactgttcacagtggcttccaaggcctttgggatgggccttgcgtgctgcccttctgctggaaaccctcccagccatttgaggtcctgccctctgctcaccttgttccctgtgcccatgacatctccccaccttttcctggctgctatgtactggtcctataggggttccttaaagggtgcatcttccaagccactcctgttgccctcctctgcagccacatccctgctctgcacacccccaccccagcaagtgtgtgtgagctctgtagtcgtgtcatggccccagtgatgtcctcattctatccctgtcccttcatggcagagtggactttgcagggtgactaagtgaaggatccagagatggggagatgatcctgggttatccaggggccccgaatgtgatcacaagggtccttctaagagggaggcaggagggtcagtcagcggagaagacagggggatggaagcagagctcagagaggctgaaggtgctgtgctgctggctttgaagacggaggaggggccacagcccaggaacgcaggcagcttctagaaaaccggagaaggtgaggaatgaatcagccctagagcctccagcaggtatcagccctgctgacaccttgttagcccggtgagactcctgacctccagtgctgcaagatgtcacacacgtgttgcgctatgcttgtggtaacatggcaccacagtgcaggatgctgacacaagcaccagcacagcgccaggccctggggtatagtgtggataagatggactggaccctaccctcctagggatgtccctctaggaggtggaggtggggaaatggggacagatattaggccattatggcagaatgcaagtgtttagttagaactgtgctaagtgcgtaaagagagctaaaggctacataataagttgtgagcctacctagggtattagcagaggtgtcccaaggaagctccctgtgagccgaaccccaaaggatgggtggaaattagcttaactaagtggagaggtgggatagtcatgggccaaggccccaaggcaggaaggaataggcctggtctgtgggtctgagaggatggagagggctgaacacgggccaaaggagaaagttagggagggaaggtggagtccttggcaggggctcagctcagaacagggggagccccaaaggatgtgaggcaagggagcaatgaacaaatctcaccattgtaagatctgaaattcagaacggtggcataggccagagtaggacattgtgaaaaagaaacaattagagaagcagaaagagtgcttggaaatgtcaattatgctgctgaattaaaaaaaaaaaaatcagtaaaagatggaagtaaatctccctgaaagtggaatgaagactgaaagacagaaaatcagaacacccaagaaacatgcagactcaatccaaggacatccaatatcctgctattggaagttccagaaagggagatgagaggaaatagagactaaagaaagggcccactgagaacctctagcagaaaagagcagccactgtgtcatcatgcccttcaggaacagcagagataaagacaacattctagaatcttctcaaagaagtaacaggtgattttccaaacatgggcctctgaacagatcagtctttggtagagaaaatttatgaagagagatgccttcaaaattgtgaaggaaaataaaattctatacctagccaaagtatctatcaagggtgaggatacagtaaagacattttcagatactcaagaacttataaaatttttccaagtcactgcaggaaaaaagtatagaatttgctttctatcccttttcttagaaggttctggagaatgcactccagcaaaacgtgggaggaaaccagggaaaaggaaggcaccaacaacaaggaggcagaagaccctacacagacagaacagggaggtccaagcccagcagctggctcagggctacaggcctccagcccaggcagcccaggcaggagcagaggacaggatactcctgaagaggccacccaggaagagaaaataggtgggactgggaagaaaatctgcaacggagcttccaaaacagcggaggatctccctgagggaggtgttgttagagaagagagcagagaagcaggagaacccagaaaggaaatgtgagcacagtataccccctggctctgtgggggacccaggcagtgggcatagatttcatcaaaacaatggggaagctgtgctggacagttagagggtggacaaagccgagggtggggtgagagcttaagcctcaccttcatacaaggaagattctagtagctaagattgacaagtcgagaaaccatgtggccagcatgtcaccaaaagctgataagaggaccagtgatgggcttcccgggagtggagctgggcatgcacactaaggcctggaggcttgtgcttatccatcatatagcaggcctgccctttccacagcacaaacaccttgacacacaccgtcacacacacccatattcgacacacacattcacacaaacacacccagacacatgcatgcacatggataactaactcttccagcaagagccaccccctggctgaagtgtgaggctgtccatggaggggccagagtagaggggaggtgggtgaggaggctacgcagaggccctgggaggagggaggctaggcccaggggtggaaagaagacagatacgagaggggatttggagacacaatccccagacttggggacgagctggatatggtggtgaaggaggggagtcttcaggaaagacccccaggttctggcttggccatatgttggaggctgaaacgattcatccagacaggagcagggaggaggacacgcagggcctgaaaggttctgaggtgtccacgtggaggtgtttgcccggcagtttaggctgcaaggctcagcagggagattggagctgaaaacagaggctgcaacatggaggtggtacctgaagaaggggtgtggatgaggttgcctggcaagagattgcagggagaggagagagtgagaatggggccactcaaggggtgaacagggccttgcagtacaggaagcagctgggggtggcgggaagaagacagtcaggagcttgggcatcctagaggcccccgggacagctttgaggaaggaacgtcccctgggttccacaccacagagccatagaattctgtacttggcctgtctcagtgccgtgccgcatccatcctgcccctggcaccggagggtacactgatcagggacacgagttcccctgccgggcacagagcaggttcccagtgagttctggggcctcagtgactgggcaaggacaggggcgtttggacaggggaggccgggtgtggatggaagctgtacgatggggcctgggccagggattgtgggccagctccgagctcagacattggtctgcacatgtggctggtgcaggaggcgcagtgtgctgggcctcagcctggacacggctgtcccatgcgcagagacagggtcacggtggaaagagagtccagagaacatgggaggtgccgtttccctgcggcgggactggggctggggcccggcttccccgaccctgctgtcgggcgtgtgccttcatagcccaggaagccagttcctggcagggtgggctctgcagccaggccgccagggtgcagacccagaccaatgggaggccaagggaggcccgcagcccagaccttccgagccctcagcctgctcagctcagtgtccttccagggaaatgggcgtttcctgtgggaaggtgccaggggccccgggtgctggaagagcaagcaccacgcgggggggtaggggcgccccagccctctactggccagtgtccctccagtcgtccagcccttgctgccaggggccccgcccatgtgcctggaatcacaccctggacgcttccttctttgggttagatgtcgtcgtcttcaacaaatattttctgaatgtctgctatgtactagactctgggaacacaggggaaagtatgtggacctgcccatgaggaagtcagtacagtggggccatgaacaataaacagacaattaattatccttcgcggagctgcgcgggggcagctctcccaaagcagtcagtcattcacacttcagtatgaatgagtctccgggtactttgctcagtaacggactggaccagcgcggcctccacgccagggactggggcaagggtggagtttggagtaaagagagaggcagggcaacccctttccacagacactttaccacctccccacattgacaagctggctccccagggccacccggagccccttcctcagatcctgtccccattggcatggtctcagcccctcctgccccagtaccctctccccgaggcctcgtcctccccgccatcctggaaacgattttgttgtctgcagagattatgtgtaactgcctgtgagttataagcctccacagcaagcagcctgttacctaaccaggcctggctcatgccaatgtcttgagtaattattggggggcgggggctgtccagcccgcagcagaacctctccgagggagtgctattgtttttcatgtcagctgcattttaaggctacatttcacgtcagctgtgacttggaaggaaagagggcccggcctttgaaaaatgaagaaattgagccggggttgggggcggggagggcaggttaacccttcgggctccagtattccccagcttcccagggtctcctggcagtaaccaggccagctgggggtcagaacccgcggccaggcccagcagccgcctcttggcagcgctgatggaaaccgccgtgcggttccgcgcagacagtcacggaaactcaggcagacccggcgttgggtgcgccaggccggtgtgggagcactttcccccgccccctcctgctgctgcttccccgaaggcctccccagcagacctgcagctgggcacccacagggtagaaatgccctggattggctgtggcacaagagggctggcccagcacacccagcccaccactgtgctcccagagggagaacagagaggggtgcagagggccagagaggcacggggctcccctgggcacccctcgtcttggggcccctgccctgcctccactcagaatcccactatgtgcttggagccatgctgggtgctggggagacacactaaccacttccccatatgctcacagccagagagacacacaggccagcagcctgtaaaccactgggtgtggggtgtctggtcctggagtgacaaggacagggaggaagaaagccaggcaggtggcccatgagccgtggagtaggtggggaaggggacatctccaaggaggtgacatcggagcagtcctctaaggagtttggagtcattttcagtcactcacaagccacaggagggcttcagcctgaagctcagaggtgatgtgcttagatgtcacagagccgggaggggaacaggctgggctgcagagaggaggccaggcacagtcacctcgtgttgctgtcccccaggtaggagataagggaccagagtcagggcaggtgggagaaggggaggttcttggttcagctgctgctgagacagtgaccctggggacagcccaaataagagagaactttgccacccgcagggtcccagagtagcagaagcttcagggctgatgtgtgcctggtgaatcagcctggccccagacctcctctctctgcttgctttcctgtccacaatccagtgcttctgtcctatggtccccagcggctgctcctgcattcaccatcacatctgcattccagcagcaggagggaggtaaaagacatgaaggacaggccccactcctgtaaaaccctacacagaagcggcccacgtcatccccctttctgtccacccgccggaatgtgacgcacgcctgagtcgctgcaagggcccctggggacggagtctctattccaggcaggcaaacactcagcttaattcagggttctgttgattaaaaaaaaaaagtggggtcgggggggcgggggagagcggctatggagacaagtggctgttttgccagagggaaaattccacatgtggcttggaggccagaccagaaggactcagataggagttgggcgcttgagggaggaaatgggggtacacttcagcggctcaggccagggtgtaagtagcaggtatgtggtggtactgttttccggaatgaagaggaaggggcgggcagaaggcagcgagagctttgtttggggtgtgtcgaattcaagatgcctctgagacatggaagtggtgaggtcaggggccgggaaccctatggtggtgttggccctgagtccaagccaggcaccaccgggcacatagaggtcttgaaagctcgaatgtggggaggccagcaacagagggaacactacctgcaaaggggcgagggcaggacaaaggctggcagcaccacacaggagccagcagggaaggggccacagccgggactcagaggaggcagccacgtgcagaaaggcacccatgggaacatggctcctgggagctggaggacctcagcaggcagggactagcacccaagaagaaaactctgagaagtcaggacaggagatggtgtcgtcagggggctgctggaaggtttggtgaccggagcagcaggtgccagagctgaaagcactggttaaacgtgatgggtaaacacatgtctatttcagcttctttgaatcccactaaggtgacagtaaaggcatgaaaaacatggaaacatgtaaatcaactagggtaaagtggtcaggagaaaagaggagaccaaaaatatgttgacaaaggtttggaagctgggaagcaggaggacagatggagactggcctaggagactggagagggtagacaccaagccctgcaggaagaagagccaccaagaatgaggcagttcccaacccaggaccctgacaggcaggtctcaccccagcccatgaagccagatgctactgattctcaagctcagctagagacaggttgagtctccagaaaagctgagcctgagaggttctgaacttggagccaccaggagcagttgtgggtggggcaggagctctcgtgatgaaaacaacagggattcagtaaatgcattcaagctaaaaaggaagacctcctcccccacttccctcatcaactcccagaatgcccggtggggcacaccattgttttcagaacaccagcaataaagcagacactccacatttccagagagaaaaagtaagtcacacacaagagaatagaaaatcaaaacggtatccaatttcttaacagcaattcagaaagctagcacatagtagagaaatgccttcaaacatctgagggaaaaaatgatttcccatccagaattctatacctagtcaaactctcaggtatgagaatagaataaagacatttccaaacatgcacagtcaaaaattgtatctaccacatgccttttctcagaaagttacttgaggacgtgctctagcaaaatgagaggaaaaaacaaagaaagagaaacacaattcaagaaccagggagactccaacaccaaaaacaaaaggccaagagaattttcaacatgagtgaaagaagttctagcattacagctgctcagcatgcctacagtgcaaacagtcctgctaagactccaggaagaaatcccagaagaaaaaaaaaatgaaggtgatagactgccagtattctcaataggatgaaagaagttttacaattcttacagaaagttcaagaatgaattagtgacagatgcagtaaaaaacaagcaaaacctaaggccatttgtaacccaagggaaaacaagaagatgtaatcataacagaccacaggacacagctaaaaacagtgattacatagtgacataaagagttatatactgtttgtgtaaaatgcaaacagtaagtacttatttagcctagaattctaatttaactgtgttggaaagataagggagtggggagggcaggggcatgagaacaaaatcttgatcacttctcttccatgttaggcagtcactagataatgtctaaagtgacaaaatttcaaggaacagcaatgtaaatgtgtagtttggaaatgccaaggtaaagccaagagatagtcggtagggttgaagggctgcctctgggaacagaaattagagatagaagatctagcgcccagggaaggctgtttaaagatgggagagcttcacgggttttctcactaagggtaagaaaatttaagaaggaagtgatggtgccagagaatagggaattctgccaataccctggtggggagggggagggggagggggaggaggatgagaaggaaggaggagggaggaggaaggaagagggaggaggaaggaggaggaaggaggaggaaggaggagggaggaggaaggaggagggaggagggaggaagagagagaaggaagagattggccaaggagctctgagaggggaaggtgggtgcatgccaccctggctgggaacagcaggtgtgtggtgaaggggaaagaccagcaggccctttacaccgtgggcacaggctcaggactggctgggtgctacgcaggagccctctgactagctggggctggggctgtgcaggataaggccagtgagagaagaggactcactggtgggtgcctcctccccacctttagcaagggttgacagagggatctgggctcttccctgggcaggcatcccagagctatgacctgaatgatatcttagatgatctccaaggccccgggatctaagtccctgttaagtcccctgttaaaggacctaggtcctcccaatggcctgcaaaccacacccagtctagtcagcatgtatccccacaccccagtcccagtgtcccaagaacctcttcctccagccccgggagcaggaagggcgggctgggagctgcaggatggggcctgaatctctcatcaactcacagggtcagcctgggccaggcaggctgggggccagcccaggacctccttcctgggtggagaccttcccacccttccactcaccttccgagcattgtgggccttcccaggaacccccacatctccgtggccctcagacctctgacctcccaagggcaccccacgtgtgtgccctccagcaccctggccacagagccacacacctgggccttcccctctccccatcatcaggtaacccagcacaggctggcccaacccctctctaggcctcagctttcctgtcaggaaaatgcagggttaggagctgaccagggagtctttgaaaccgcaagggtacccttgggagaccccgtgcaggtcttgtcaaggcaggacagggaagtggtgatgatgagaggcagctggtctgggtgctcagccccaccccagcacccgcccaatgggccccctgagggaagctgcccatgctctctgcgccccattttctggcctctggcatgcagagggcagccctgcctgcttcccagtatggctgtgaagccaaaggcggcgatcaatgggatgttctcagaatgacaggtgctctgtgatcagcagcagctgctacagggatggccatcgggtgcagggcaggatgtccctgaggaggcacctcagcagacgtgatgggtgcctgtgcccacagttgggccatgagaagaagtatgtggcccggcctgccctacaccatcagggggtgcttggaccagtggcggctggaaataacccatgaacaggggagagaaggggtgaatgccttgtaggcctggaacactgtggggctgtcgaaggtgcttctgcctccaggaagccctccctgactgtggagacacaagaagctctccaggtctctgggtccctctggtactctgtgccctgaaccaccacccttaggcccagatctattcctgatccttctctagacttcagtcagtttcctcttgatgtcctggatggccacaaccatagtgtcccctccgctcctctctcccccgcttccttccacattgcccctcctcccctttccccttccccaccactgctcccctccttcctccagcacccttctccccgctgccctcccctcccctccccgctgccctcctctgcctctctccgttgccccctcctccctcccccaccagagccctggaaggctaggtacagcgaggaagtggccactccatgacccccagtgatttcacttctctgagcctcaagagtctcacctgtccagggtccatgggatatgcctgactcagcccctggcacatggtcttgcagtggcctgagctggacatgcccctggtaggaagctggaaaggaggccctgcccgtgtaccaggagcctctgctccaggggggtggcctgaggcccaggcagacctccacctccaggcagccctgcaggtggacagctgggcctcaggcttaggacctgggacaactgcctagactacccccagccttcctgacaggtgatagcttcattgtccccaggacacacaccagcccggtccccaccctaccctttcccagcacccctgagggaaggcctggcccctcaggcacagtgggggttgcccggcatcttggcagatgggcagcgttagagaagccttggacctggccctgcaaatggaggtaccagagggctgaactagatgagggacttgaaggctcagatgcctgtgcgggacctggcagggtgggggcttccgggctgggagactaggacagggtgcctgtgtcccctcctgggagtggggccgtcagagctccgaccgcacagggtcatggggagcaagaggaaccaggatacccacaagctgctcgctcagacgggctctgcgactccacaactcaccttcccctactgcaagatcagggagatgggacgcagtccccgcccatgcccagggccttggcagggtcaggagagccagtgcaggcaaagcgccaagcaccctgctgcctgggagaccacagttgcagcaggaagccctcctcaggtctgcccgcctccccggagcatgttccctctgtagctcccggtagggcctgtgtggagaaggttgctgatggcatcactgagcggcccagctgtggggtgaaaggcaaggctggggctgatgctccccaaggcaggaggagaccatggtctggctggggctgccccaggtgacaactgtagggtgtggggaaggtggctgccaccgccgtggtccacagggcctggccagggctccatggggcagaagccatgcccagctcagggggcttcactccactctcccactttgacctggtccctcccctctcccccagagtgacctggacactagcctcctcccagtgggagacagatgtgggcaatgcagctgctgttccctgctcagggcaggctggtgcccaaggactgcccaccagaccaggggataagaggttggcagcatcgtccatggttatcccacagctaggaggctgtgggtgtgggagaacatgctgggtaggggtgcctgtgtgcctctggagtcgaggcaattagaggccctgtggaagcccctgcacgcaaggggcccacgcgccagggcagaggacatagccccttcttgcttccctgagggacgggaggcctgtggacttctggacacaatggcagagtcagggcagccaagccgggccagtgccctggagccgagtcctccccccacctgcccacatgccccacccctctccaagcttctcccctcataggatcccagagccccttgggacctctgtgaagactgcatagatgtgagggagtctcagccttagggtgggcacctgggcgcagctgtcaggccccaagtcagccccaggcacgtggacctgggagccagcctcaagggcaggggtccccgagcatccccactgctgccccgccagcaaccgtgtcactgggaggcaagaggctgggttcctggggtgggcaggcttccccgcttcactccatttgcagcccctgtcttgcagaggcaaaatggaggttcagagaggtgagcaaacaccaggtcccatgtttgcacctggctgtgaccgtgcagtccactgggcccagcagcaggaactggggcaagtgccccgagacgggaccgagacaacagtggggaaggtgggacaggcagctgggggaaggccagagtgtccagcaccagcgccaggggccgttccgacaggctgaggagcggcggggagcggggcttgccaaatatgtccagatggggctggagccccagcaacttcctgccctcccagcctgctcccccacctcctcacccccttcccaggctgtcagcaggggctggggggcagcagaaccccacttagccacaaggagtgcagccaggggctggctcccgggaggacatgggcagaggcttaggtccccttacacacacacactgctgcattcgtgcaggatgggctcagcgcctgctgtgcctggcgtggctgtgtgcatggcatggtggtggcatggtgggagtggtgtggcacatggtgtggcacatggcatggctggggctggggctgggttgtgtagcatgtggagtggcaaggtgcgtgacatggtgtatggcatggtagtgtgcccctcgagccatgtgtccaggtggggcagatcatggagggcgcccaggtgcggtgctgaggctgagcatgcactggctggggagggtgggcagagcaggaggaaatcccttgttctccggagctggagagccagaaagagccctgcagcctgggcctcatcatcacacctcgccctcaaggcctccaggcacagcatccactgccagcctctgctcctgcctctgagggtctgtctccaaggtcttttgggggctgccccagctcccccaacacagacagcaccagagctgggcccacctgtgaggtgctgagttccccatctcagagactgtgcgagcagaggcagggaggcgcttgatgtcggatggagaaaggacaggggaggggtgtggggctcagggccccgccaggtgaaggaacaagcttggaagggtgtccttatgtctgagagttggggagacacccccaagccccagatgggcctcgaatgccaggcagggccaagctgggcccagaagtgggaaggatcccttggctgccccaggaatgcaggttccggggcaagaatccagccctggctggttgaagtccatcccaagtctccctccccacgaggctcctgcagatgccaggaatggggctggattccagattccaagcctggccgcccagcccctatctgggaccccagcccagggcccccaggcctggcctccaacctggccccagcctcaggggagctgaattcagagaatcctgtcctaggagccagaagcgggggagggagggagggcggccctgtcctgggtgcaggcccgggggctgggggctgcccgcccgtctgggtcagccgcagctgcaaaccggccctggctgagtcatggggcctccatctccaggcctggcttgaggtgggaatagcagtgaggttggacatccaggcacctggagggtgggcagggctccctgcggctggggtggccagtggcacctggctgttgcccccctgcaccccagccctttggcccccaagtctctgccacctccctggggttctgctcccatattcctcacacccagcacagaacccagcatgtctcctgtagacacctgcatataaaccctgactcacacacacacacacacacacacacacacacgcacacatgcaggccaggctcctcggccagtcaccctaccggcagagctctagacatttctggcctctggtgactattcttcaggcagctcaccctgcaagtctttattgagcacctactgtgtgccaggcagtggtacagcaagggcagaagccccacctccaaggagctgaccccctgccgtggcagagacagaaaacaaaggcagcaccacagcgacgagggcctgagaggaaagtggagcaggagcctgcagcatgctggggcaggggtgtctttagaaagggtactgggagggccctggcaagggacttaagtaattacttaaaggagggaaagggtggcctggggctcacagaggaaaagccttcctcatggaggcggcggggcagcgggctcagcctgcagtgtccaggagcgacgggaagcctcgtggggctgttgggagacagcaagacctgggtcagcagagcaccgtgtggggtaagcagatgacagggcagtgacagggtgatcgggcccggtcagtggtcccaggggtcggggacaggtgggaatcgaagtcataggaggcggggcaaaggccacggggaaagggacagagctgctcccaaggacgcaccaccatggggtgccccgtggcgtggcgggggtgggggtcaggacctttagcagaaggtaaagatgagaccaagaggcagatgggtggaagagttgaaagcagccaagtgtcaccaaggcatttctgagggagagggacacgactagtggctcaaatctttagaaatgaggggatgggtctggtagagcaccccagattcaaggcgggtggcttggggaaagcagggagaagggtctggaaactgctgctgagcaggagcccccacacccacagagcaggtgcagggaggcccatctgtccatccgtctgtctgtggggaggcatggtgacgtttcaggccggaggtagaagttttcacccaggaggtagagggtgaggccggactgcactccaaggggaggaggtgggagagcacagcctggctgctgccaccaagctccccagaagaggggacccctccccccgaacaccagcacatgtaggcagaaagacttggcctgtggagccctcagcctccacgcccaccagcagggactgggtggtgatgtcagcaatccccacagaaaggagggctgcacagccgtcccaggagccagcactgtccccgtgattctacgtgcagcctccacaagtgtgtcgcatggaaacaagcagtggagagccacatgtgtgtcacatcacgcctcgcctcactcgtgctaaacctcgctgaccaggcagaaccaggcacgagctgcgtatcaaagttgctggaaggagaaacatcagatccctaagctggttacctggcaggcaggggccctagagggaaatggggcaggtgaaatggagatgtgtctttgaaatgtctttatttggcgggagaacgtcttcatagggtacttataccatgaaaaaccctgtacacagactaattttgaagcaaacatgtgaggcgttcacagaaagggttcaggaagacaagcaccccagccgcagagagcccgtgggctgggggcacggggcatggcagccctctcctggggatgggcaggatggggcacgtagggcggaggaagaggctcacatggtgtgcgtgtttgggagcaccctgggcagcctctcgagtgtccagagagaggacaccgtcttgagccagcagggacagccaagagcgcccggggagaggcctgggtggagacagaacacagcaggctgtgggcgtggccaatgttgagggacggaggtggccagaggcctctcagtggtgcccagggagctggggacgaggggcctcatccttcccctgagcccctcccttcaggcccagggagtggcctggggcccaggagagcccgctccgcgctcacagcctccgttcccagacacgcccgggcctgagcccccaggctgcactgtgccacagaacagactccccggcccctccctgctcgagaggtgaccaaggcccagggtctcccagcgagcaagaggccattgaactgttgttggctgtgcagtgccctgccctcggggaggcggcctctaagaagcacacaccaccagcaggaaccgggcagacagaggtgggggatggaaagcaggggaagtggccacagccaaaccaggagggggaagggagggggcctcaccaaggagaccctcacctggggcctggagaatgagaagggtctggaggctaaggagaggggtggatgctccaggaggcagggccagcccatgtgagggtcctgaggtaggaaccagaggaaaccggctctggggcgagaagggcggcgcccagggggccacaggggccggcggcgagggaccctcagccgaggctggtatctcgagaacagcagggatgcctcaaaggttctcgcccagcaagtggacattgtggtgtgggagatcagcaggtgccggtgctttctctgtctgcaggaaggagagggggtcatgggccccagaggcctctgtcttagagaaaaatggtggcaacgtgggacagactgaggaagccagcccagaaacgtcccgtcccaaattcaggaatatttagggtatacctgctgcacgccaagggcagtttcaggaaggggacctacttctgagaagcaaacaccaccagtagggaccaggcagacagaggtggggatggaaggaagccagactgacctcacgtggctcacagccactggcagggtcgggggacaggtgccaaactatccacatgcccgtcaggcacctggaggagtgtgaaacggcatgcagaaagaaggaagcaggcttggggctgggggccagggaccggcgcgccgggaagcaggctgcagagtgaggccagggatgggggctgggccagaccacagggttgtgagcggactctggcattgatccggagccactgagggttagagcctatgactgacaggggtctgacttccagtggtatggggccaccctgctgggctggggaagggaggcgagaggaagtatctaaggtctgcttgtggacttccggggacagcgaggggtattgctggggtcctaggggctggtgcgctcagaggttccagatggcccagcaagtggctgagggcccagggtaggggaggatgtgggggcagcagggccgatgtgggcagacctggagcaatgacacgagaacggccaggcagccctggcttcccctgcccacctgcccccgtggccgggctggggtttggctgaggcagcagagcgctcgctggctgcccgaacaaagtgttctgcctggtgtcccctggcctccgggcctctgcgggctcgccagagggggcagctcaggaggcagcggcagagaatcaaatgcaggtggggcctgtgcccaccgccagcacaaacacggctcctgggcccccagcctgcccgacgttcctgcccgcctggcccccaaacagaggccgatgggacgagccctgcccggggttgcactaggtgggcaggtgggcaggtgggcaggtgggcagctgcctcgggctcttggacagagccgcccctgcctggcgtctgccggcaggaagctcctgaggccgggctagggataggccagcccttgggggaggctcgagaccccatcccagcctggggcttccccaccccctcccacctgcctggcagtgaggcagctccctggcctctgggtgcacctgggcctcctgcccaggccccttccaagggaagagggcaaaggggctccagtgccacccagggagtgttgtgccacgtgggcccccctggctctgccactgactccctccatgacctctgtccccaccctgaagttgacatgaatgtccgcacggagcagcctctgcaggtctgtgaggctgtggatgtgacagctctggctctggcacaaacgtcagccccaacccagatgcagggagggaggtggctgcgtgtccaggagcacggggccatgtggcaccggctcatgtcagcagacacggcacacatagaccccctgggggctatgacgaggtgagggctgagccgagggagaatccaggaaggcgtgcgggccgagaggaagaggaagggaggctctggtggctggagccagctgggggagggaaggcagcaggggctgggatccctcagcccccacagccgtggtgcggactttgttgtttgctcagagtacaaagaagaggccttctccgggttcttagcagacgagcgcgacctctccgaccagggagacagacaagaggggaggttatgaggtcacctgggagaggtgtgggttccagctcccgtcgccactccccgactggatgccagaacgagcctgtcgtctttcacctccagacagcagggccctggctcccagtatcaaagcatgtacaagagcggtctctagggcagttctgcgtagacgccaaagtacaggaagacgtgcaggaactttgtgccgtcgacccttgaacaatgcagggttggggcaccgacccccgaactgcccagtcaaaaacccatgtataacttttgactccccagaaacttcactaatagcctcctgttgactggaggccctaccaataacataaacaatcaattaacacattttgtatgcttcatgtattacaataaagtaaagtaaggaagagaaaagatattcattcagcataagcagatcattgtaaaggtcttcatcctcgtcatcttcacgttgagtcagctggggaggaggaggggtggctcttactgtctcgggtgacagaggaggaagaaaatccacgtagaagtgcacccacacggctcaaacttgggttgttcagggtcgatgatacacaaaaaggacattctaatccagtggggaaaaggtccatcattccataagtggtggggtatcagcaggataacctgcaaaagtaagtctgtaggtcagaaatcaatcccaggcgattcaaagatttagggggtaaaacacaaatcaaaaaagtattaggaaaaaagattttggcgttggaatggaggaggcccttccaagcacgcacaggatgagaaggcataaaggaaaagatggatggctttgaccacgtgaaaaagtgaaaacataagtaagacctctgtgtggcaaaacaaaaaaataataaatgccataaacccatacacgagacaaatagcacactagggaaaaacatgtgtgatgtgtacttgacatctttcttaacatagagtccttacaaatcaatgaacgtgaaaaggcccagtcccagcctcagcttctctgctcagcacccaccctgggagggagtgggcttggggggcttctaccccctcactccagccttggggccccgggaaattggccggggcctcacttactaattcaacaaacatttgtgcagcgccaactctaccctccatgtatttactgggcaccttctaggctccaggctccaggctctgggagactgtctagggttaagatggtgactgcctggcctagagctgggcctccagctggtggcaaaacaccaagcaaggagatcaataaaccgggacatttcagggagtggtgaaggcttacaggaacatggggagagatgagacgaggaggccgcccaggattttgagctaaggttacaaagcagcagaggacagcgggtgcaaaggccccagggcccaactgagatgggcgctcagatcaacacgggcatgctcagtgccggagaggggccagcggagcctctgggggcactgcaaaaggagactggattttactcccagtccagtgggaattctgcagaaggatttggcccaggctgggagggaaggctcagcctggctgttgcctggaacaagcggggaacaggttgggggcatagccaggcagtgaggtggttgtgacagtccaggcagaagatgctgccagcctgggcaaggggcatggggggcaggctcagagcacatgctccagaccagagagccacagacaccaggtgcacaccagggaccctgggtagttggtcgtgccctgtggatacaggattcgggccggcttgggaggaatctgagctcccgctgggacacgctgagctgtggggctgttggcctgcaggccttggagcccctggagagagcaagtagctgacggggacatcctagctagccgaggtcccaggaagggaacgagggtcgtgtggtgacgatcttgagatattcccccacagtcgtcagccagggacatggcgcccctgaggcccttggggggccaagcatccgtcagtgggcagaggctggtaaaagtggatgtcagcagcagggggaagggtctttctttcaccatcttgggcctctctcagagggaggcaaccccgctcctggggggtggtcagtgagggccagccaggcagcggcagccccaggaagggtgttggggtggagctgaccaggcctctgccgcatggttgcgctgtgccgaggacccgctgaggacataaccgaccatgagcggtgtgggtccccagccgcggcagagcttcctctggctgctcggcagacaacagacaccagggacagagacaaggttgaggatttggtctgcagcctctgagcggacacactcaccctcagtgcctgccaattcagccccaccacaggcgccagtcccgagcctgagcacaggggctgccacgacgctcgactctctgggccaagactcacacacagcctggacactgcccgggtgaagggctctgggggacagggggagcagctggtatgtgtgtgaccatgggtcccagactcagtgccatctgtctccccattaggagaggacgcctggtacctgcccaagcacccaagccatgggagttgctgcttgctctccacgcagctttgtcccagcagcacccccaactcctgtgatgggttgcagggggtgctcacctctgtggcacacacaaaggcccaggggcctgggggtgcaggcaggtgcactccaacccttgggcagcccagagaacaacctaatggaaagtgaagggaattgtacaagtgtgtacaagggtgcagggtggttcctgccttcttgcacgcacagtctcccacactcatacagccacaggttcgtacgaggtacacatatgtgggctcacctagcatgcctcccgtgtgcacagcagtgctcctttggcctcaggccacaggcatacatgtgcaactgtacgtgcactctaggaatccctaatgatcatggccatcgggtggctcgcagtgcactgagcaccatgctctgtccctggtgtcttcatgcctcagtccacttgatcccctcagcatcctcctggggaaggtgctacagctgccctgttttataggcagggaaactgaggttcagagaagcaaagtgacttgcccaaggtcacccggccaggaagcggcagaggcaggatctgaccccagacccgctgcggcacacacacgcctgcctgcacgctcccgtgaggaggtgctttgtgcccaaggccctgcagcagtgtggggggttctgaggccatctcccactggccacagcacagcaagctccagcagggcagctgccccaaggcctggcggtaaaacctcagcagcgagaaacacggtcgacttttgtccaagaactgaagcactaaagcaaagtcaaacacaatcgctccatgccctgccacgaaccgcgaccttaccacgtgctgtgacctattgccacttgtgcccagctccacacaggagccgggtctgacatccgattgctcagagcctggtatgaaacattctaggtaccgccctgagagtggcttagtaactgctggttcctcaggacagacaggaggaaggccaaggtgacctttgccctgcgaccctacagagggccctggggaggccctgcctggtctttagacactgcccaacaaggatgctagaaggggcagtgagttttctgcctcctggggaactgcagcccaggcagagaacaggacccccaccctgggagcagcgggtgtgcccggcctctcccgcctgtccctggccagtctgccatccacgaggccagggcctttggcggtcctaggcggggatcaaggccgggcaggttctgcaaaaatttcccttgaaagactctttttcaagattttcttttgaaaacaaattcataaccacatcaaacaggaatccccgttgccttgggtttgatcgccggccgcccggggctctctaactagctgttattctaattgcttttttctcttccgagggctgcataggtctcttatggttattaatttggtgagtgcaggccgggcacaaagcagcttttgtctgccttgccttttaatcactatcaaattgcaaataatggtggaggctgagatccccaaaattgatctgtcccagcagttcttggggaaccggccccagtgcctagagcatgcactgccttcccccagggcggcagctccccgatggcacctgcccggatgcacctccgcatgggtggggtctggcctcggccatgggaggtgcttctcaggctcctccatcgccaaaaaaaaccaaacgtgccagcgagatgaaggcgccctgcccgcagagtggtggggtgggactcttcagggacacgtgctgtgacaagtgcttgagtcagagctaagactctggggctgccgaggagccacctgtagcccaggcctgggcccttcccacaaggggggcagcagcatgatgcatcagactgtggacccgccctgggcatccagcccacatcctggcccacccccggggcctctgtcaccagcagctgggatgatgagagcatgtctctggggccagagaccctagccagtccctcaaagccccagttggcacaggcagcagttgaggtgagcctgggaccagccagagccaggcatgggctgacgctggcccaggcagcttcagggagcccttcagtgtccgtcggaggcaagctcggccctgtggctgcctcccgaccccaaaggtggctgagtgcctctctacacggtgccgggactccctgccgggaggagctgtcaccaaagtggctcaggactgagcgctgattccagccacaccctcagcctgcactgcctgcctgcggccctgacacccactgtctctttctgtcccaagaatcccctgtgaaggcctccacacccattagcacatgtgggacttggacagatgttcgagtgccataatgtgaaaatttatgaaaccacaaatgttcatctgtgatgtatttggtgctttaattaatgccaaaccaattgatacccaagctggggcctgcacagttagtgacagtaagccacgcggggcaaacctcgttccacactaccagtatgcggggcccagggagctgaggtgagccctaggacacaagcccaggctttgccctcaaagacccacgctggctgcacctttgatctgctacgctctcgtaggtctctgggcctcagtttcctcatgtgcaccctgaaggctgagagacctcccatgacccctaccaggcatgagcaggtcgtgggactgagagggctggtcctgccggcagcaggagccacgggggtcagggtgtggctgaacaagaacgagacctcaggccggtccccctcccagaggccccgccccaccctgccctctgctttcgccggctccctacctgacacactgtgtccccccatatggcagctccgtggtctcgagatggagccttggggtgggagctgtggggacaggatgggagacatggcactttcagccagtgactctgaccctcttttcctgggcctcagtgtctgcatctgtgggatggagtgtgggcctctgtggctcgtccccaagtggctttgcagagcactgaagtgctggcgggtccttgggtgtgagagaccccggtggatggccctgggcccctgcccctgccaaaccacagaagtcctgcacccctttcctccatagtctgggcctcacatcaggtttatctgggaaaaataaaacatggggctccctctggcctggaccgtcagacctcggatgtacacctgcccttgtgttcaggacagttgggtctcagactcaccccatacctgcaaggcagaaccacaggggagccagggagcctccacactgcagcccccaccacccagggctggaagtgggtcccctgggctcctgctctgggcagggcacagtcccaccctcccaggtggaggctgcccacctagccctctagacagacgctcggccccactcaggcaggcgcccccctctcatctcagcctctcacagcaccctgttggccgcctcttccttagcctgctcagcctccgtggtaggtgctgtgggtgacgaccacagcacccagcctttgaagctggcccgggtccacccagaccctagcaaactggttgctccctctctggccatcccggggcttgtgcccacgtcacccagcagcatcttccctggggttgtctcacccgcacagaacccagccctggcccacacctcaccccaagcctatccggctggatcagcagtggggccgggcgcatgagggaccaggcccgcccggcgcagcctagggtgcagacccctggagtgcacggccaggtggaccgggccagctcccgcctgctgcctgtgcttagggccagtggttgacgttgctgtggctgagtcatcttcgtgcctctctctggagccatacgtttccctgaagcagctctgctgttcagcccttatcgcgtgctgatctgtttgcccctcccccaccacttctaggtctttccaggcctccaggtacccacggtgggggagggtctacttcattctccacagagcacgctgaggggctctcctgcaagaacaccgcaggctgaaggaccagccctgtctcctgtggccaccaacagagctgtgcgccctccccgaaccctcactcatgctagggcccccaggtccaacctcctagggagaggggtccccaacctggactccctcacctgccctagtctgcccctggggttggccctgctccacccagcacctgctctgagggtgccagggtgccggcctgccggccagggccttccagtctccccatcaaggctggatggccacttcccacccggggcgggctccagcctcattccccagcggtgctgtccttccaaggagctctcagatcacctggctgtccactcgtttggggcttctctgctgcctccgcagcactgcgaggcctctgatcacctactctctgtgctgggtgcatttcgggttctgtcctgccttgacctccctgccagctttgcagggcagccaccctggcacatagctcactgcagaaccagcccctgagaaggtggaggccacatggctagccagagggcacgctctagggcactgctctgaccacagaatgtgggtgcagatggtgtctgggaaaatagtggtgtccccgctaggttaaagacatggcataatggttcctgggggatgacaaaaaaacccacccccacccccttgcagaaagcatcacagaggcacaagccctgtgccctgcaagcccctcctggaagtggcccagcaggggcatcccctgcacacccaggcaaagcccaagccctctgcctcctcaaccaccccaggccctgcccatgagccagccttgctgaactctgccctctgtccagttctcctccagacacagtagacatagcccccagcctttcttgacccttaacccaaatgtccccaagcctggcctcaagaagccaaaggctgccgcaaacccaaatatttcaggtccgggtccctggtgcagaccctgccatgcggggatgtggcacagaaggccggccagcctggggagcagagaaggaggagaggagagctcctggccctgagcctgaatgcctgtggacacatatagggactcccagcacgcacgggatggactccaatcggcacacatgcacattccttgcacacacacaggcgcgaccgagggccttgcagacatagggtgcacacgtgcgtgccgcctgcatacagcatgcacttgcagagacggttggcaccttcccttctctggccccaaacctgggccctgaggctgtctgcacacctgggtgcttcccaccactgactctctcgtctgcctttgtccccgcaggtgacgcagctggaccagaggctggcactcatcaccgacatgcttcaccagctgctctccttgcacggtggcagcacccccggcagcggcggcccccccagagagggcggggcccacatcacccagccctgcggcagtggcggctccgtcgaccctgagctcttcctgcccagcaacaccctgcccacctacgagcagctgaccgtgcccaggaggggccccgatgaggggtcctgaggaggggatggggctgggggatgggcctgagtgagaggggaggccaagagtggccccacctggccctctctgaaggaggccacctcctaaaaggcccagagagaagagccccactctcagaggccccaataccccatggaccatgctgtctggcacagcctgcacttgggggctcagcaaggccacctcttcctggccggtgtgggggccccgtctcaggtctgagttgttaccccaagcgccctggcccccacatggtgatgttgacatcactggcatggtggttgggacccagtggcagggcacagggcctggcccatgtatggccaggaagtagcacaggctgagtgcaggcccaccctgcttggcccagggggcttcctgaggggagacagagcaacccctggaccccagcctcaaatccaggaccctgccaggcacaggcagggcaggaccagcccacgctgactacagggccgccggcaataaaagcccaggagcccatttggagggcctgggcctggctccctcactctcaggaaatgctgacccatgggcaggagactgtggagactgctcctgagcccccagcttccagcaggagggacagtctcaccatttccccagggcacgtggttgagtggggggaacgcccacttccctgggttagactgccagctcttcctagctggagaggagccctgcctctccgcccctgagcccactgtgcgtggggctcccgcctccaacccctcgcccagtcccagcagccagccaaacacacagaaggggactgccacctccccttgccagctgctgagccgcagagaagtgacggttcctacacaggacaggggttccttctgggcattacatcgcatagaaatcaataatttgtggtgatttggatctgtgttttaatgagtttcacagtgtgattttgattattaattgtgcaagcttttcctaataaacgtggagaatcacaggctgggctgggcactgctctcaccttggttcctggggcatccatggggtctctcacagacaggacccctgcagttcccctggaagcagtgcccaggtggctgtggaataggaacgctatgtccgtgtactgaggagtaggtcagggttcagaggggctgcaagatgccatcgaaggctctagcttagcgacgtcgctcctgttctgggccctgggctggccctggccatgaagtgcagtcacagtgtggtcactgcctgtcttccagcagactctatgcccttgcggcagatgggctctgtctgggcctctctgtctgcccctcccaggccagggtggcccttcatcaaggacccacatgctccactctgggagcaggccccacccaggcccattccccaggatgccaagggctaaactctggaggggttgtggtgcaaggaaggcctggggcccctgaggctcccatatgctcacccctggcctcctccgggcctctatttccccattggtaacacgatgctcccttagcctgtccagttctctgagtgggacagaggggccaccaccctgctcgccctgaccctgttcctgcagctttctgtgaggcccgcctctcctaaggtggaaagagtgcctcactctcggcacagacacactcaaccggggcaggtgcatctgctgtgcccccacctcagctattggaccgtttctcagtccttcaggactgcagccgccttctgtcctctttccagagcccatcccgaagtctcaggatatgagggcttggggcatctgagatatcaaggatggggctgtcctgagtccactgggggcaggaggcggccagcagcaggtggcagggacaggggccccaggtttctgtgtggagtaggggtggaagcccttgttagagggaaaggccctgggtcccacctggtgccaagcccactgggcccgtgcccccaacccatgggtcttggcatctggcctggccagcactgaccgggatggacgaggtggaggggcagcacggggcttcccaggcttccctggcctgcacccctccgggaggagcgggagcagcagttactgaaaggcaggaactgttgtttccttgttgggtaaatatttgtggaaacccggggatgccggccggaaagcagggccctccacagcgcccaggccccccagccccggccgcccaccccgggaccctggcccacagggagctccgtggggccgcccatctgggccgggcgcggccccggcacccagcccgccttgttgtccatattatggactgcgcacaaagtgcccgaggactcctctcctggacgggccattgcagccctctcgggtgtgaaatgcaatttacctgaaataaagcccaattatggaattagctaattaaagccatggcggaggctgggcctggccggccgagtgctcaatgcccgccggtgcccgtggactgagggaacagatggcgcctcggcccgccgtgccggccgcattccttcactctgtcccccgataagtgacctagacagcacacgaccatctggtgtgtggcacgtcctgcgggccccggacaatggcccggcagacctctctgcgagagggccgtcgcccgggcaacggtggcatgtgcagccccgacccattcacggcccctcccgcagcccctttcttcgggccctttgtggcctcaccgcggctgcctggctgctctggctgaggatagccatgagtgtttgtccccagagccggcctttgtctccaaattgggctcccttattgaggtcctcggggtccaatgggtgccaggagcatctgctgggggtgactgggggaggggctgctcctgcttcctggggcacccacctcctctgccaggctctcctcccccgttgcctgcccccagatgtcccctcgtgggtgctgggcgtggccatggggaagcccgtctctagggctggcactggccaagcccgaggttctcccatcttcgggccagggagccaggaggaggaggagtcaagggcggggccgacctgcagcccctcagctcccaccccagtcctgtctgcgaaatggggaacagtaaaagtgccccctagaaggggcgtacggggcaggggcttgatggagatgagacatgtgagcacacagtaggtgcttaataaaggaagccaaacaaaccacctgggtgggtgatactgggctctgcctccttgctgctctcctgcctgttgcctcggagctcctttctgaggcccctcctgcatctagccttaccccaccaagctccctgcccctcggtgccagggagagctgtccaaacccaagctggcagttccccatcctgctctcaagccaaccatgactccccactgctgagtgggcctgtgaggccccacaggctgcaaccctgccactcaccctgggcatcccccgccatgagcccagcttccccatcctcaccctgtacttgacgtccagcccccctccctactcaggacctcctctgagcaccatcttggcaggcagtcccccaccagcgtggtggtcaggagtcaggcccaccactgggagaggggctgtgctgggcctttgaggccccaaaaaggagccggggctggcagtgcctagtacaagcctggccccagctgggtgctcaggaagtgccagttaaattaaggaataaaatgaaaagttggaaggaggctgcccagtgctgcatgtgcagcagaggtaccaggacccaagcagggcatcaccaggcgtccctccaatggacaggagaggggtccacaccctgcgccctgaaggagggatcaggccaggtgttttgatctggggcagccagacagctgggggaaggagcaggaaggcagacaagagccagggctcctggggccaccacacacagcacccccatctccaggggatttgctgagtcacctgcagggatgaagactgccctttctcaactatatcaagtccctaatttggagtgcccatctgagctgtgccaaagcctgctccccccagcaccccagcctcctctcagcacagccctccgggctctaggacccaggggttccttgcgaatcttttttttttttttttgagacggagtctcactctgtctctcaggctggagtgcagtggcacgatctcagctcactgcaagctccgcctcccgccattctcctgcctcagcctcccgagtagctgggactacaggcgcccaccaccacgcccggctaatttttttttgtatttttagtagagatggggtttaaccatgtcagccaggatggcctcgatctcctgacctcgtgatccgcccgcctcggcctcccaaagcgctgggattacaggcatgagccaccgcacccggcctccttggggatcttaagcgtgtctcagcctcaccattctcggcccccaactgcaccaaccccgctcttgcctctggccctattcttgtggccctggagggccagctagttgggagatcaggcctgtggcctgtgtcccagcacccttcacctttcctgtccccacccaggtcagccagggtcccaggcagccaggcctggaggatgcttggggcagccaaagccaaacagagcttcagtttccactggcctctgagtgcagacagccggggccagggccccctggaagctgacaggtcccaccccggcccttcccaactccactgtggagccttggtgaggaagcctagagggccctcagtcgggcagtgcaggagggctgggggctgccaccccagcccaaggccttagaggccaaggccccagcctgtcccacccaggcactggctgggtaataggaggcggggcatccactctgccctcaagatccttctccctcagtaggtcctgctatgacctcctggccctcctcttcagcaccccgtaccaggcctcctacaactcccctcccctgcagcccccacagctcaaggcacctgagtgaggcagagcgtaaaggagatggacagcctggcccagggcagccctgctggactccaggagatgcttgggcccgctccccactcttccttctagaccctcacccatggctcccagaggggacgaggccgcccttaattcccagagccaagcccagccccaccgcccacctatccccaggcttgggtttcgcacacgtacaggcagcgagcccgaggcccaggaagacacaagccgggcccagaggtggccatggatggctcagtggacagaatccatcctggtgccttctggggcctcaaacacacagctccttccacttcccgggagtggccccaaggtgcaggggtgggggtgtcgagatggagtccagggcttgtcacttgggcacagtgatccccacctgcatgacccatgaccctggaaaccccccccaccttctcctctccccactgccggcccctccacaacattccccgtgacatgctcctttccagcctgcaggacgcatggggtctttctgtggcattgcagctgagcagcatcagggcaggaggtgcaggctctgggaaccaggctcacagcttcatctccctcctgggcctgcgccctgggaagccggtggcagcggcaaacccacggagaggagttaacaggtgcccgaggacagagaagactcatgctgaggggagagaccccagagcaaaaaggcctcagagctcgtgaagccccccacccggtacagacagggagaccaaggctgggggaaggccgggcctgtgctgcgcctgtttgtgtgactttgcattggaaaagcctcagagaagaaatggggcttccacagcagagaaggtagctcagccaggaagccagagggcaggaatgaactgactggctgaaagcaagagctggccttgccagacctttggccagagaggccagatctgaggaagagatgttcaaaattccagggtggtctgagcacagctcctctgctggcccacacaggccaagaagccacaaagcactgtgcctgcctgatacagccaagggtcaggtgggccttcagaacacaccgactggctccaagaaggctgctgttgcacctgccacacagaaaatctcaaacttcccagttagatcctcaagaaactctgttacagcctgaccgcaaatgtgattcaccaaaccccactgaatgacttttggttgtttcttaaccacatccctcccctggccaatgctgacacacagctacacacacctgcacacacacacaccttcacacatacctacacacacacctaccctacaaacctgcacacacaatacacatacttacacacctacacccctacacacacctacacatacacctacacacctacacccctacacaccgacacccctacacaccgacacccctacacaccgacacccctacacacacacacatctacacacctacaaccctacacacacacacacacacacatctacacacctacaccccgacaccgctacacacacacacatacctacaacacaagaagtgcctccactgtgtgtgtggcacgaggcagtgggaatgaaggaaaagctgaagccagaagccagggatcccctcattcacagcctggctcagcccctctctcaggtgccctggggcaggagccaggcttctctgagtttcagtcgctcactgcaaccacagctccacagaactgaccccaggatcctcagtggaagagaagatattgcaaaagccggcgccaacgcaagaccaaacagcaatgacagagctcactgtgctcagggagaaccatgtactgacgtcctcttcagtccagcaacctggagctttgacacacaaacagcccctgagacagaggtctccgcagcaaatccacccacgggacacttctgccaggcagagcctgagtcagcacaggtgaccagagagggaagggccccaaatgccatccagttctcccagaacagccgagggaggtcacaagtggcccaggtgccatggggaagagtggccccatagcaaggccaggatgccgctggtgtcagaagccccccgagcacccagaggggcagaggatctgtgggaggagccttcaggtgggcactcagggagcactcaccccaactgtgcccccagccaccccaagaaggcctggccggaagcatctctgccagggacaatgggagcaatgggctagaggtggactggccaggctctggaagaggaggctccagctgggagaggccacaaccccggggtggggcccctccagggcacttgagggtggaactgtgcagcccctgagtgttgatgggcctggcctgggccgaccccagagactccagcagaggcccagggagctggaccgtagcatcgcccagggaaagggcccgtcctgggggtgggcaggaggctgcttgagaaaggcttctaaagaggggttgtcaggatggtggtgaatgccattaaataatttcaaagggtcttaatcaaatcccctctcggtccacgagatcatgtcaaaggactctggagaggaaaagaggggcagacacttcccgtgcgtcttccacttgactggctggccctgcggcgtgggggcctgcgggctctcgctccgcctgtaactccgtttttgaccccagccaagcctgtctcctctctgggcctccacctcatccttggggtgaacccacactgcccagttcagggagcaggcaccacctcagagggggtctgcaagggaaatgtctcatctcaccgctttaggaggaggcctcagcggcatctccaaaccatcgacgcagctgctgagaaccaccacttacagaaggggaaattgaggcatagaagagccataggatggggaggctctttcacagcttccagagcctgaatttcctgggaacttgggcctggtgcttgaccgtgcattgccttggtttctcatctatcaaacaggctgagaccacatcctacctcacatggttagggtgggctgtgagccaggcaacgcagcacatgtgataggtgcttccagaatgttctacggtgacatctcaagcccacggtcctcaatggtcctgttgggctccttcagaatccccccagatgccccacatcatctgccctggactttttttttttttagagacagggtctcagtctgttacccaggctggagtacagtggcctgatcacagctcactgcagccttgatctcctaggctcaagtggtcctcccacctcagcctcccaagaagtggggactacagtacaccaccacgcctggctaattttgcttatttttttgtagagacagagtcttgctgtgtcgcccaggctggtctcaaactcttgggcccaagtgatcctcccacctcggccttccaaagcactgcaggtatgagccaccgctcccagccgccttgggaattttttcaaagtatagacacaaaaccttcgtattgtgtgttcccaaatgtcccacagccgtaggctggacaaagcagggccattcacctccacaaaaccttcctattgtgtgttcccaaatgtcccacagccgtaggctggacaaagcagggccattcacccccgccacagccacacacctctcccacctgggtagttaacctgcaagtgctaagggctctgaaaccacacagcagcggcctgtgatccgaattgttctgcagctgtctgtcctcacccatctgatgctatggaacccatctgtggagaccttcctgttctcctgaccttctgcaaagagtttctcagacagctgtgacctaactgtgtccagcctccctatgcaaatggaaattcacccattctgggttgagctgagattcaaactcacacccagccaccccacatgcaccctaagagccaaaatcactctcccagagctgttcccggccccatcaagcaggtgcacgggcaacagtccgggctcagaagctgcctcctctcgggctcccaggcccggccactcctctgacaccactggctacgaccactgttctggggcaaagacagccaggtgggcatacccaggttgggggctgtggatggaacaaatgaaccagtgaaagctgggaacactcccaggaagagggctttgtgtgcccccagccctggtctcaccccttccctggccctgggatgaggagagtcaccccacagaggccttccagtgcaagtgccagccggggcccctcatcgactacctgatgctaccatgcccccagctgatgggacagagatgaggccctggaagctcagccctcgtccaagggcacccagtgaccaaccgcacccgctggacttcaaacttggagctctgtgccaccaggaagccccctcacccccaccactgaaggagctcgagaaacgccagactatgctgctttgggatgtagaccacctggagctgcaggcaggagaggcggccgccaggggcatcggcccagaaggcccctcacctcctccgctgagggctgcccagaggcaatgtgggtcccaggggacttttcatctgcatctggagaccaccgtcactcatgctccctccctggccctcccacgactggtgcagcccccaccccagaagccccagcccctattcctctctgtggttgggaggacatataagcttaaatcaccttgcccttctctgggtgtcacgctttgtggccttccctcgtacgtacataatgaaaattatttctttccttctgctaatctgctcagtttaactcgtggcccaaagaacaagggcggggggcaagacaatttcactccctgcactaccaggagcacctgtgcctccggaggagccagcagagagggccggccccagccctcatctcagcagaagccaggctgcgctagggagcagagaggccagtgggggtcagtccccaggcccctggtgccacgaacacactcctccctccctcccccatggcccccctgccaccatccttgaggtgaagcaggcagaactgtgtcccgaaaacgctccacagcccccgcgtgtgtccaggtggcttcagttacccggcgcctggctggcccagcctgcagagagccctgccaaggcctggcaccgctgtcccgagcggcccctcttgccgccagcgagcccaagaggcctcagggcacaggcagactgctttcccctacgcggactggcccctgctccccaggaaaaggcttcattgtctcccaccccccggccaccgcctggctcaggagacacgggggctccaagctgcgaggtcacccggccttgcagaatccacctgcagccgcaccagtccaggaaaccaaatcccagcggcagatgacagccgagggtggcaggacagagtgcccattcagcctccgctggagccggcctggcctgacctggcggccgcctcccctacctgggccctctggtgcctgagcccaggcctcacttagcctctgctgaccagagagagggctgggacgtgccccaccctggggcacccacaagtgtgaggatggctggtgaaggtggcagagaccctgccccacaaccagggcctcctgcagcccagagtgggctcaagggagtctccaagccaagcattaacagggatctcctttgaacttgccaagcattgctgccccatcttacgtatgaggagcctgaggctgggaaccaactcacctttcagctgggtgcagccaagctggagcctcgctgactcaggggtccctcctcagtgagcagatggagaaggtggcctggaaagggccccaggctgcacagcagcctgttgtagggaagaggagacgggccaaggcatggggacacatggacccatttcacagacaggcagctgaggtggcagcctcggcagcaagctgacaagaagacaccaggacagcccttgcgtgagttgcatcgaagacaggagacccgcccaccctcccctccttaccatcctgcaggacctgagaccaccagccatagctggtccctcatcgcctccccctatccccagccctggcctctgcatttgggcaaaggctatggaggaagaggctttggctttttggccctggcttcagccaaatcccccaagcacctcgtggaggagaatggctgcacctgggagccacgtgggctccatggaggccctaaagagaccaggcctcagccccaggtgaggcttaataccccctctccaggcagaaagtaaccatttcttttccagtggttctccagcttagggtctccagccagactggccgcttatgggccaggtgtaaagagagggacagagggggcagggaagtgcgagtgttctcaggccactggggcccgtccccacccacacccagtcatcagccccagggacagccaggccctccgcagtgcagggtacaccccgattctgcagccgggccccagggcccagtgcttcctccaggctgccccgggctccctcctgagtggcaggcccaggcccggactctggccccaacccgcaggctcagaggcagccctgccttccacagaccaggccacgagttgcctgtcactcagctcttctgcctggttggtcacactgaaaagagcatcccgtggctgggaggcatggatatcagctccaactcggctcaggaagcaagagctggaaacccaggcgcaggaggcatcttcaggcccggcgcatgctgtggcagctgccccaggtcctcccaaacgccacctgccaaactggccctcctccccatctgggtttagcaaactcctactcatcctccaaagcccagagcgaaagggctcctcttccatgatgctcctcttccaaaagcagcccagggtctcccctacggcactcagcacccaccgcagacactgtctgtgtccttgaagctgatctccctgccagacgggcagcggccctcgagggcattgcaaatgggatgcctgacaagaacaacccttgaggattaggaaataggggtctgctggaagccaatgcaggctggatctgagacctcctgaagacaaagcgcagggagctgtgctcatgctcacactgggcatggggttcacactgtctgctgagggctgcttccctgtcctggaggatgggaaggacagaggggaaagaggggctcacccacatcctgctctctgcacagtgccccctccagcgcctgtccacacagaccagccgcactgcagtccctcagaagccctagggttccaccccatctatgcaccctctccctgggttcatgcctgctcccctgggcccaccccacccatgcgcctactccccccacagcccacccatccccagaaccctccttgcccacatgccacagcagtatacttttgaaggcaacactgaaggtggggagtttctgaaatcctctgtgcttccatctcctctatgggcgcaccccaagaggttgggagagcgaggtgctggtgcccagcccagcacagatagatgaggccaccgtccagtctacttcgtttttccagacatctcacacccataactggcctgaggaacctcattccagcttccaaagaacacggagtgccaagcaccaccacaccccaggctccacacctcccagaacccttgtggtaggggaaggagggggttactctgccccatttacctaagggaaactgtaaggcctggatggagaagtgccccccctccagctcacacggctaccaggccagagacctttgccccaccacacatgttggcccacagatgaggcggtgagtcattcagccacatcacagacgggagatcccctgccccttgggaggagctggagtccccacacctgggatccagtgccaggctttagcacggacccctgtgtgcccacacccaccctgtctgaaccccccattaagggactcgtgtttacacaccggtccctgagtccccgatttctgagaaaattaattggcagggtaattctcactagagtgttgttgacttctccatttgtagcttgctctttctgacagtatctgcactgcagagggagaacctgaagaagacctcacctgagctccgaggtgtggatttctgggcagatttgagactttgtggcccctgctaaggggatataattgagggtccccataaatcatgactcggtctatgaggaaccagcacctagctgcatccccagcctcttccttcttcacacccaagcaaaaccccaggttccagccccacctagcagactgagggcaggccatggtcccccctgctccattccagactccactctggcttttctccttcaggaaacctcctcataaccctcaggctgggtccggggcccaggccctacagatgtgctgggtgctggtgctgacagacaggacggcaaccgtagctggacctcaccctggacagcatcgccacaacccccactggtccacctgggagaacagagacccagagatagccacacactgtcctctgtgcccctcattgccccccaggcctttggaggttctgggggtggctactgcagtttaatttgggccacaacccctaatgagcagcccaacggcatggggggcagtttgtaggcacccagagcctgagcaatgtggcagaaagtccagggggccttccaggggcctccaagtgacccaggtatctggcagagcccagctggccccagggctcccagtcccggcctcctgctccccggcccattggccctggctgcagcctcagttgtaccagctggggagtcccagatttcctgtaccaccaccccacacacttggtcccctaaagacctgatactgagctcttgctaatcatctggctgtcactaagctgccccacaaccattttcaaagagtccctgatttttaaggcccataaaacactgtgaaatggcctttttcaaacattgagggcattaatgaccatggcaaaaacaaaaacctgtccaggtggccagtttttagtagctcccaatacaaaattgcccccaccacgcagcccccacctgtccacgccccctccacttacccaccccgagggattctagccaggacccctgcgtcctgagaaatcctttccaggagtaggctggggaataccggcccagaggggcgaggaccggatgggggcaggggtagggttcaaggggccagggtcccaggggctctcctggaggctgcagaggaacccagcctgggtggggggctccgacgctccacagcctgtcctggcccggccaggcccggcccggcccggccccctgcccagtcgcggcactgcccggcccgacccccagaccttcggggtgcccagtccgagcctgggccgctaggggccgcgggcctggcgggcggggcgggggccggggtcgggggtccggcgagctttaatgcgcgcacaaagcctcatttgcaggtcaatgccgcggcacactcgcctctcccctcgcccggcgccctttgtccggccgcgcccgctcctcgcgccagatggccgcggaaatgctaatttcgggcgcccctgcccccccacccccgcgtttaattgcgcctttgcagatgggccgcgagtgtgcgcttcatgcagatgagcgcggcctcgccgccttcctcggacctccgggagccgcggccgggcgtgctggggccgagggcagggagggggccgctgtccctccactcgacgcgccgccgggcacgggcgggcacccagcggcccgggcccgggaagcgcgcttctctcttttcatttctccaaaatgggatcttaagtgattctgaatgaaaacaaattggcccgctttcttctccaaacagacgcgcggcgcggtgggggcggcgggcgcgggcccggggcggcccgggcggtggggttggctccgggaccccctgcccggcccggccctcgcgccttctccccgcggcccgccttcctcagccctgggccggcggcacttggaggcggccgggcaagacggcagacgtgggggcccctttaaccggagccaaggatccccggactttctgaccaaccaggagcagaagcccgccaggtcaccctcgcctttcatgacagaaacagattcccaggctggtcggagcgcagaaatgaggcaggccagggccggcctccgccaccccgcccatctccagccccagcaggagcctggcccaggcctctggccccacagcgccagggagcatcctccgggagcccaggcctgcctcgaagcctagggctggggcaggctgggcagagtgagggagggaggcagtttctttgtgatgtgtccactttactagcaaaatttcaaccacaaacttagaaaacctatacattggtgggtgattcacttgctccaccaccagcgatgaaacagagacagagccacgttctgggtaagtaagaatactcccaatacaaaactcagccacagacctttaaaaagaaaagggtgccgggcgcggtggctcacgcccgtaatcccaacactctgggaggccgaggcgggaggactgcttgagcgcaggagttccagtccagcctgcacaacctggcgaggtcgcatctctacaaaaaatcttctgatttttttagccaggcgtagcggcgcgcctgtagtcccaggaaggatcacttgagcctgggaggtggaggctacatagagccatgactgtgccactatactccagcccaggtgacagagtaagaccctatctcaaaaaagaaagaaaaaaaagagaaagagaaagaaagagagaagaaggaggaggaggaggaggaggagggaggagggaggaagaaaggaaagaaagaagaaaaagaaaggaagagaaagaaagaaaaagaagagataaagaaagaaaaaagaaagagaaagaaagaaagaaagaaagaaagaaagaaagaaagaaagaaagaaagagaaagaaaatcatctgttcctgaaacattctgtgatactttcgtaatttgctcagccagaggactgaaagtgcaggcggatccctcagccttgggctcagctgggactgaagtcagctgacagagtgaatctggcccaactgccaccagtctgactctggcaccctggccctggcgtgaccttcacagccgcaccccccaccccccacctccgcctcaatgcccaccctccagctccacatcactgagcctgccctgctgcgcccttgcacgggcaccctggctgccagctctcctccacccattcctcctctgagtgtcctcaggcccctcaggggctgctcttccctggacacccaggagcctcaacctttgccctgtgccacacctccctcacctggctcttgaaaggagtcccatccaccttcccctcagggtgaagctcagggcctggcccacacccctgctggtactcaaggcccacctgggggacctaatggggggttccagtagacaccgaggccgaggccggagggctcagccacccttgtcacccatcctgcagggcactgtctcatgggtgccagcacagtgacatgccgtgggctgggggaagctggctcatagaatatgcacggccaggacgcaccgtggaaatttccatggtcacgggatggaaaccatttcctatcaataaaataacaggtgccccgtcagaatccccctttcatttctttccaggaaacagttcaaatgggatggttacacccatttgagacaaacatctcttggtcctaaccccttgtggttgcttcattaaccagaggcctccatcttcctctggggaagacagtgcagcccagctgccctccgcctccaaaccctccctgggccctgaggtgccgtgtggacccactgctgcaatcgccatgttcaccccacactcgagggtagacccagagcatttgaactgtcctcgtactccctcggccacttctcaacaacagcgcattcccaatcctgtaacctggggcctttccctaacacatttaaaagacgccagccgccttctcccgccctagcactgtcaccagctgcttgtactcaactctctgccaaactgttactttgtttatcacactcagattacgggtctcttgaacagtttgttatggttaaatactttcaattaaaacagtatatgtttgtgtgtgtgtatacaaatagatagacattctaatactttaaaataggtactttgagctgggcacaatggtgcacacctgtagtcccagctactccagaggcagaggtgagagaatctcttgagcccaggagttccagtccagattggacaacatagcaagaccctgtctctattaaaaatatacctttatgccagatgcctataatcccagcactttgagaggccgaggcaggaggatcacttgagcccaagaattggagaccagcctggacaacatagggagaccctgtctctacaaaaaaaaaaaaaaattaaagattagctgggcatggtggcacacacctatggtctcagccactcgggaggctgaggtgggtggagggcttgagcccaggcgttggaagctgcagtgagccatgatcgtgccactgcactccaacctgggtgacagaataagatcctatctcaaaaaatattttttaattaaaataaaatatgtgctttggacttaaaaagtaaatgtgagtcccatagatgtaaaatgatatagagccccaaagtgccatctgcgcttatctcaggatagcagcatctatctgggggaatttttactgtcttttttatacattcccatattgtttgcattttttttttttacaatgagcatatgctgctatttctacaaccaagggaaatatatggctattttcaatttggaaatcaaaagaaataaaaagccccactggcttgccagccctgtgacctgggtgctgtagcaataatgcctggaactggccccagccgatgagggaccccagccacagcccatgccagagtccactgtcaggaccatcttacgagaggggctgcctcagaatggagtcctgggggcacctcagtaactaaacccccttggatggaagccaggccagacccactcagtgccaaattccactcgggcctgctctcagttccagcaaaattccaaagtatattgttgttatcgttattattttgcaattacgtgacattttttaaatgcctagactgttttctcagccattttcattagctccttctcactctgcccaagagacacttcagcattgtgtctgccactgggcaggctggccaaggctcagagaggtcaactaacctgcctaggttgcacagcaacagagcagcgggtgcgagagcagacgtcagggctgggcccaggtcatcctgcagagctggggggtgggtctcgctgttgggccctgttgggcttttattcagatttaggaatttcttggggggcgggggcaggggcagatttgggaaagagaagaaaaagtaggaacgagagaagagagaagaaaaggcaaggaaagcccaaggccgaagcaagagagcaaaataagcagaagacaccacgggtgtggggctggcagcaccgcactgagagcccctggcagggaaccagcccctggaggtgcccctgccttctccccacagcctggcatggtgccggcttccagaggagcctcgtttctcagtgaggggggcgggagggggtgagacagcatccgtgtctagacgcttatcctttgaggagaataccagggtccccaaatgccacttgagatctctctgaaatgcaggaggccctggagcctgcatttgtcatcagcctcagtcaccacacctacccccagctcaggagcaggtgccacagctcaacctggctctcatgctgaaccaggtccccagaggtctggacattgccactcaccagcaggcatcccgggccacagggcaggacgcccaatctggaagcccagtgttatgggaggaatcgtatcccccaaaaatcatatgtcgaagccctcacccccagcacctcagcacatgactgtatgtggatacagggttttacagaaaacagttaaaatgaggccattggtgtgggcctaatccaacaggactggggtctttataaggagaggaggacacaggcacactcagaggcatgaccctcccaggacacagggagaaggtgacgtctgcaagccaaggagagaggcctcaggaggaaccagccctgccgactccttgatcgtggactccagcctccaggactggtagatgataaacatctgctgtctcagcagccctgtctgtgatgctttgtgatggcagctccaaggcaggaatacacccagcatccacagagggattacatctgtccaggcccgcacagccagggcagacagagagaccacaccccagccctccagaccagtggaaacccccacgtacccctggctcagagaccttctctgactgagcgcatgaagctggctcttcctggctagtttccctcagatgcatcatcccaacacctaggggcacattgtgcaagtagagagtcccccagtataccattttccaaggcagagacaaaaaaaaagccatgtgcagagttgacgtctgtatacccctaatgctaattggggacagtggcatttagttctgagtggctgacggctttggtgacctggacaatcagggcctgcctgaagaaccaggggctgccggaggcgctgggcctccctcccactcaccggggccttcattaacagccgcgtccagaccagctggagtcagctgattagcccattctaagtggcattgggagtccccccaccccctgtatctattttttcacccgcacatgttcaattcaattttgcttttgtgccagagaggcctctgatgtgagtgtttctggggagtttttccatgtttctttatgtcctcgaaaccaaagtcagtcaccaactttcagaaaacaccctcctggattgaagcgggtaagaggaaagaaaaacacacaacacaaaacaaaagcaaaagaaaacaaaagagaaagcactggctgcctttctacagaatcctcctgcgaggagacaattcatttcaattgaaacgtttccattgtgcggcattcggaacgcgctcctcgcgttgggcagaaatgcaaatccccctttttcctttgattcaaatatttaaattttcaaatatatatgctgcgacaattgaatggcagctgacctcacttattttcatagaagcaatgcggaagccacaggctgcagttaatctcgccagcagcgccccgcctgctgacagcggtacggtcagtcctgggggggcgcagggaataatccttttattcagacatttggcttaaaagaataacaaggaggaaaagctggaacataattgcattgcatggaaaacagagaaagatttttttctctctctctaacaagctttctccttttccttcctcaaagaatcggaggctcacggccagaggctgttttcttggtaaagaaatcgggagtgttttccttccactattgtccccactcccgcccaccccccgagggattttcatagttgggttggctgccacactggctcatccattcattcattcattcactcactcactcattctgcaaactcggaaggaagacctactgtctgtccagctcagctgggctgggggcagggcgagccagacactccccaggcagccttcctctcctggactgggacgcccccacagagccacaccgtgaccctcggaggcaccctgaagcataactgggccaaccgtgcctgcaggaagcccctttgttcctccttggggccccagagcacctgagtgaaagagtctgagaccggaggggcagccagagggggccctggagggaggcggagggaccccctccctgggccagccaggccagcgtctgccagagtcgctgttgctaagtcctcttcttgcagcctggggatcccagaggaccccggcccagtccatcagctgggctgggtctttaatatttaaagagctctcccggacatttcaagaactccccgacacgattttctgtgatgcgtgggctgtcgggacatctgtcttctatacctaataaagtcgcccgacgcagaatgaactcctcggcatcgctttgaatccgggctcacatatggttgctaattagctggctatctcttggagttaaatgattttttttctcgccccgttcgcatccataatagacgcgaacagagtcgtgattgttccctgttgcgggacattctgcgcctgaatgagcgggggctgctgtgtcgacgcggatttgccatatggttgcgcggagccaggaagaatgggcccctgtgtgtgcgaccgggacgcagcggcgcgggccgtgccagccgggcggagccgggtgcccgacggcgcaggacgagcgggcgcaggacgagcgagcgcagcgggcgcgggcgcaccgtcggggcgcggggaccccgagggccagcggagccgtgctgcgcgcagggatggacgctgggcgcccaaggcccgttcccgtggacaggcgcgcggagggcagcaggaccgatgcaccgacggacgcaccgacggacgcgcggacagatgcgccgaccgcaggctctcccgccgtcccggggccgtcgtgcccgtgcaggccgcgagcagcggcggggccggctctgcggctgcagcagccccattgtgaggccggcgagacaatgggcggcccgaggaggcacctgctcgcctgaaaggcccataaatcgccgccgcgtccagctgccttcccgcccctccccgcggacccgctagcgggaagcgcggccgcggccgggagggggaggctcggtccgacagtcgggcagggccgcctgggccaccgccgcgcgctccctcccgcctgggcgcagctgcccgcacgccccgacgggagctgcgcccagcctcccctctggagtcggcgctccaggctgctgcccggccggtggccaaggccccagcaccaccgtccctcctgcagggcatccagcacctacccttccactgggcggctcctggttctggtcccggctggctcactcaggctgcctttggaccagattcttgaacttttccaccaaggatgttgctgctgtttgtagcgtcggatcctggaaaatcgctgtgttggggagcagcaggctctcccttgctcccccagggcctgggaaaatcaacccacctctgccccccgaccccagggctgtaacctggtgtctggtagccccactgtgataaaccgaagcccagcacagtttgggactcgccccgagttgacttatgcagcccccagaacagaggctgaaacccggcgcatcctggtgaagccacacccagccggcctggtcccaggccccgggcacggggtcccctccactcccatctgcttccctttcagagccggggctgagtcggcagggacgcaggctcagggccctggattcccgctttctggacacttgcgtgcatgcccagcaccagctcgcccttctgagaaagcaatccctcctcagaggggagaagccgtggctgtgatgggcaggaagtggtcaggacccactgccgagcaccaactccccatgccaccaccaggggtgcgcctggactcctggaaaggggtcgcgtcagggtgcagcccatcaaaggcttcccaagaggcaagaggcaaggagaagtgtcctactttaaacggccagcctcaggtgagcaccagagatcgggcccagacctgtgtagagaaaaggaggcaatggcccctggctacagacaaggaccctgaggctgccctcttccctctgcacctttggttaggcactgcctctctgtgtggaaggagcaggactcggtcccaagaccatttggccacgctgtgccctcgggaccagcacgtgctggcaccccgatcccactgggactctcttccaggaaaaggcttgtgttcagttcccagggctctgccaacaccagccctgtgctggctgcctgcagcaggcaccccatggggaccacatccctgggcctggaggagctggctgagacagaggcgggcccgaggccaggcctttgcccgccactgctgctccaggcactcctggagggctctgagcatgctccttaggtctcccggctgcagggaggacactcactcccacccccaggtgtctggtgctttgattttaattatttctagccttccagtgccatctcttatcgccccctccccagtctcctaataaagggccagcgccccccgccttcctctagcctccctgacatattagaagaatgtttttccatttcctttgatgtctgttacaagttgcatctcatttcctgcttgggcatttctgacctcgagtgactccggccgccgtggctgcgtggctggtctgctcctcataccccgcccagacgccagcttgagaggatttggtcctccgtgtgccgccaccgccaactcagtttccccctaccctccccactttgttttctggggctccaagggggaggtcaggccctcaaccctgtttccatggagagggctcctcacggggggcgggggggcatccctccatgggacagggagggctcctcacggttgaggggggcgcccatccttctatggggcttcctaaagacctgcattcttcccttcatttttctgggattactcccctttcagtggtcggccctgttcactctgccacctcagagagagtgaacccagcagaggtgtgacgggaggctggggagagaccccagcaccttgagcacacaggagccaggaggagcccaacagagcagcaggggctggggtcttctcctgaagcctgactccatgggaccccaaagaagcagatggaaaactgaaaaagaaaacccctcaagtgagccactggaaagaaagcaaaacaagagaaaataaatgagttgtttgacataatttaacttgtctgtttttccatcttccttcctgctcaccccaccatcaccgtggccccatctagttgaggcacacagctctgggcttaaaggaaccaaggggcatgtctcagagcagtctccaaattgggtgctaggacccaagaaatgcagagagggcagtggctgtgagagaggtttgcataagaaaacagacaagacagaacttggttttatctttttttttttttttttttttttgagacagagttctgctcttgttgcccaggccagagtgcaatggtgtggtctgggctcactgcaacctctgccccccgggttcaagcgattctcctgcctcagcctccctctcgagtagctgggattacaggcgcccaccaccacactcagctaattttttttttttttttttttgtaattttagtagagacagggttttgccatggtggccaggctggtctcgaactcttgacctcaggtgatctgcccgcctgagccacccaaagtactgggattacaggcatgatccaccacgcatggccagttttgccttaaaaccacagctagactcctccacagggaccaggacctaggccatgtctgtcctggctgcagaggtgggtcagccccatacagtgctctctggaagagaaacagggagcagcgtggctcctgcacagaggcacctggctggcccttggcctactggtagcctccaagggtagatgccaggtatctcagtccatttgtgccacagtaacaaaatacctgagactgggtgatttattttctattttttatttatttatttatttatttatttttgagatggggttttgctcttgctgcccagattggagtgtgatggcacgatcttggctcactgcaacctctgcctcccaggttcaagcgattctcctgcctcagcctcctgactagctgggattacaggcatgtgccaccacacccggctaattttgtatttttagtagagatgaggtttctccatgtttgtcaggctggtctcgaactcctgacctcaggtaatccacccaccttggcttcccaaagtgctgggattacaggtgtgagccactgcgcctggctaattttctaggtttagtagagatggggtttctccatgttggtcaggctggtcttgaactcctgacctcaggtgatccacgagactgggtgatttataaataacagaaatgtatttctcaccgttctggaggctgggaagtccaagatcaaggtgccagtgcaatcagggtctggtgagggctctctgcttccaagatggcactgtgttgtaagtgaagcgaacgctttgggaagcctcttttataaaagctttaatctcactcagagggaggaaccctcaggcttaaatacctcctaaaggccctatttctttctctcttctttttttttttttttttttttttgtgagacacagtcttgctctgttgcccaggctggaatacagtcgtaccatctcagctcactgcaacctccacctcctgggttcaagcagttctccctgcctcagacttccaagtacctaggtaacaggtgcccaccaccatgcccagttaatttttgtatttttagtagagatggggtttcaccatgttggccaggctggtctcaaactcctgacgtcaggtgatctgcccacttcgacctcccaaagtgctaggattacaggcgtgagccactgtgcctggccctttttttttttttttttttttttttttgacaggatctggctctctggctctgtcaaccaggctgtggtacagtggcacggtcatggctcactgcaacctccacctcccaggcttgagtgatcctcccatctcagcctcctgactagcacgcatcaccacacctggctaatatttctttttttgtagagaaaagttctccctacattgcccaggctggtctgaaaatcctgggctcaagcaatccactcacctcagcctcccaaagtgctgagatcacaggcttgagctactgcgcccagcttcccacttacattaatactatcacattggccagtaagtttcagacacgaattctggaggggacatagtcaaacccagcaccaggtctcaggtgtccttacttctccctctgcaattccggcttcaccacagccctcaggtgtaaggccttgttgtccagaccatgtgctttttcccaggactgagagtgaagtgctgaggttgcatgataaaaacccatgtgactatatgaccattaaagtgaatagcccccagagcactgggcggtggggaccggggctccctcctacacagacagaccaattaaggtcttccaggcctgcatgtaggccaggctacagggatggaatcagcacccagctagagcagaagggtctaaaggaaccaaaaggggttctgggacaaatctcaaaccatgggcaagcttcgctcaagcactcaaggaacattcgagctagatgggccctcagagactctgatcctatgttctcctttcagtgagggaaaattgaggcccagggaggcttctgcaccctagacaggccccactccttagagggaccagtgaggggaagtcagaccccagcaagacggaggaagtcccaaattggagacaatcagaaagacaacaccagtgcagaccctaaaccaacaccccacctgctccaagctgggctccagtcgcctaaggatgagctgggcccatgcaaactccctgtgtgtttcctgcatgtgggccaccaggcaaccaccctctaacttgaacccctgcccacagaccccagtaccacccaatggttggccaggggcacccccaaaggattggatcatgccgaaggtagccacaggcagatgacagtgtcaaagggaagggggataagtggtttttgttcacgcagaccataggagtgaaggttgtagcattcccaaatgtaagtccgcgtggctaagaccacgggcagggctccccagctggcctggctcccagtgtctgtgcattatcgtgtgcgtgtgaggcatttccacttggattactatttcagctcccaaaaatggatcagtggctcacaggaggatccaggaagcagcaaatattgacccgtcaggatttcaaggtgaacgtgggatgtcccctacatgcagggaccgtccaccaagtgtgacactggacacaggatgtcctggatttgtcccaggtgcatggtctcttaagacacttggccagatggtggcgtgaggccagcagtggttttgtgtcattttcaagcaaagcccagggccttccctgggagctagcattgttattctagaatgagtggaaagggacactttccagggcaaagctgatgtgcaccacactgaagatgggaaagaacccacgctgtatcttcctgtccacattgcatttgtaagaatgaaacttgcgtgagttgcacggaggaagaatttgcagttgggggaatgcagtgtctgggatctgctttttttgttgttggtttttttcaatagagacagggtctcgctatgttgcccaggctgatctccaactcctgggctcaagcagtccttctacctcaatctcccaaagtgctgggattacaggcatcacccactgtgctcagccagggatctgctttatgaaactgcagaaaggaaaaaaaagtaaaagtggaggtgggaaacagattgacaagattggaaaaatgttaatgatggttgaaactggctggtgatgtactattctattgcttttgagtatgtttgcaaatttccataagaatgctttgtaaggaagtagcagtgatactgttacatattgctgagaaaatgtaaaaccaaatacaaagttaacaaaaagagataaattatgtacatatagacaatatatgcacacatacatacatgtgttgtgtgtatacatacacattatgtgtacgtgtgtatgtctataacatatagacacatacatgttatgtacacgcacataaaagaaggcagaaaggctgtgggcagataccctgatcaagagtttttgtgacatcatcacagtggccttgcagcccttactcaggggtccttgctgacatgaactcacagcagtgtgcctctcaactaggcctgcatctttctaatttgctagacaggaagccactcctggcacttggtcaggtcaaacacaagaagtgtttgatgatttttttttaattctgttaattactgaaaatccatgctagaggaaaaaaattgtttttattttgaatttacttatttattgagacagagtcttgctctgctgcccaggctggaatgcagtggtgtgatcacgactcactgcagacttgacttcccaggctcaagcaatcctcccatctcagcccccaagtagctgggaccacaggtacacgccaccacgcccagataatttttatattttttgtagtgacagggtctcactgtattgcctaggctggtctcaaacttctgagctcaagtgatcctcacaccttggcctcccaaagtgctgggattataggctgttttgaattcaggtaacaattgcttgtgggtcctgaagtaaacccccccaaacatgctggctatcaatcaatcaccagggttgggttctgtaagaagggtgttggggcaaagatggctgcaaaccctttgccactcaagcagaaaggatccccctgccatgaatctgggatggtgtcagtagcttgcttgatcaatcaaatgaggcagacatgatgctgcatagcttccgaggccaggtctctagagctgctcctaggcctcctggaacacctgctcttgaaacccagctgccatgccatgaggaagcccaagcaggcctgcgaagggagccacaggcagcagctcccagggctttgccaggcatgggagtgggccatattggaagttgattcctcaaccccaatcaaactactctagctgacatcccataacacagagccaagctattctgccaactgttccccaatttctgatagaatcataggtataaataaaaccactgggtttttttgtttgtttttttgtttttttgaggtggagtcttgctctgtcgcccaggctggagtgcagtggtgcaatctcggctcactgcaagctccggcctcctgggttcaggccattctcagcctcagcctcccgagtagctgggactacaggcgcccaccaccacgcccagctgattttttgtatttttttggtagagacggggtttcaccacgttagtcaggatggtttcaatttcctgacttcgtaatcctcccacctcggcctcccaaagtgctaggattacaggcgtgagccaccgcacccggctaaaaccactgttttaaaccacaaagtgttgggatagttgtttacttggcaggagatcatgagaacaggtgtaatcatgctaacagaagaggaggtaccggctgcctgtccacacccgactttatgcctcagtgttgaacagcagagtagtggctgtgatttggggcagaagggaatggtgagtacacacagctgtctgacactggagcaggcaagccctgccaagaaagtcctgcccctgagggctttcaagtaacagctaagatcagagcgttttcttcctggcgccactaggtcatcagaggccattttcattttttatcccaaggggcttgcccatggagcagagcttggtgatataatcaatatctcagctgcccctgaaacaaccacttcaaggcttaaataacacaatttttaattttcagaataagcaattgcgattttttttttttttttgagacggagtcttgctccgtcgcccaggctggagtgcagtggtgccatcttggctcactgcaacctctgcctctcgggttcaagcgattctcctgccttagcctcccaagtagctgggattacaggcacgtaccaccatgtctggctaattttttgtatttttattagagacggggtttcaccgtgttagccaggatggtcttgatctcctgacctcgtgatctgactgcctcagcctcccaaagtgctgggagtacaggaatgagccacctcgcccagccactttttttttttttttttttttttgagacagggtctcgctcacactgtcgcccaggctggagtacagtggcacaactgatcatggctcactgcaatctccgcttcccgagctcaagtgatccttccatctcagtcccccagggagctgggaccacaggtgcacacacaccaccaaagctggctaatttttaaaatttttttacagatggagtcttgctatattgccccaagctggtctcaaactcctgggctcaagtgatcctcccacctcagcctcccaaagtgctttgattacaggcatgagcgtccgcacccagccaggatttcttcaggatgctagagtgtgggcagccagctccatctctgagactttgacccttccccaaatcacaatcattttattccttcatcaaagaaaaaaaagatgacttactagacagttgttaaggcactcacataaaactacacgatagcaggatagatggtaaccaagagggaactcaggacccgtcactaccagctggaaacacctgacctccagcctgcaaatgtgacaagctagaccaacaccagcaggacactgaacacagcttgcagggatgagtctctgcgtcatttctggacatgtgtccaagtaaccagaacaactcaaaatgccaccaggcccttgctgtcattcccataaacctcgaacagtgagttgggtcttcaaggaacctgtctctgtcagcttaccttatgctgcataacaaacaggcccaaagctcttggcagcgtacatcaagcatggaggatctctcactcaccacgacagtcccttcgctggagggctggggttgtactccattttctcttttggaaggggcggcccctgtctgaggtctcatttgtctcacagcagagggatgaaacggcaggaccctggctttgacgggctccatttggcaatggtacatgccaagtgggtcacgtttcactgcccagagcaagttacatggccacgtctgatattgacgtgcgggaaatgcagaatcttcctgcatttggggaggcagatatttggacaacatgcaattcattacagggccagctggatgaagaacggccaagggcccaggctcttcaccccgagccaggccgaaccagccggggccgtgagatcaagccacggtcatcagtgttcgtttggaattatgccttgtccttgccgtgtccacattgtagtagggtttctgttttttaattcatctgaaattggtggtgggtgtggtacacagatgagaaacaggaactctccacgctgggctttaacaggagctgcggtgggaacacaaatggtgcagccactttggaagatagtttggtggctccttacaaaactaaatgtacccttcacatatgatccgccacacaccatccagcaattgtaccccttggtatttgcccagatgagtcaaaaacttgcatccacacaaaaacttgcacgtggatgttgatagcagctttattcataattgcccaaacctggaagccttcaggaggtgagtgggtaaacaaactgtggtgcctccggtcagcggaatattattcagtgctaaaaagaaatgagctcaagtcatggaaagacatgaaagaaccttaagtattattaagtcaaagaagccaatctgaaaaggctgatgctgtatgagttcacatctatgacattatagaaaaggcaaaactacaaagacagtaaaaggatcagtggttgcaggagctagggaggagggagggatgaataggtggggcacagaggatttttagggcagtgaaactaccttgtatgatactgtaatggtggacacaggacagtaagcatttgtccaaacccgtagaatgtacggcactgagaacggaccctcctgtaacctatggacttcagttaataatattgaaccaaaaaataactaacaataaaacagtgctcttcagacaccattacctgctatgtcacctgctgggagctggaggaggggcttcctagcccctcctgttttaaaggctaggctggtgcttggctcagctctgtcccacccccccacaccaaccacctttgtatgcaccacagcccactggaggggttttctgatgtcaccagtggagaaagcgcctgcagcagggactgctgtctctctattcattgctaagtctctggtgcctggaacaggggctggcatgctggagcctcttggagtgtccacccaacccagtgcctctgccctctgcctggatggccacagtgtccttctggtcccctcacccccttccctcttgctggcgctcctccttcctcacccagcagctgagatgcttctactactccctgcttcagtccctccggggctccccactgctggctgacaaaatccaatctttggcaccagtccatcaggcccggggaggtacaggagaccagtaggacagggcagggaagggggaggcccagcaggcacacccaaaagacacccttacactgaaccacatgtacgcccgtgtgccggcctcacacacaccagcaggccaggcccaccaaggccccctggcaccagcagcctcccctgccttatctctcctgcctcaccctgatcccctggctccgacacattcacccttctccctcatcactttcatctggactgtctgtaggttaacggagcaactgcctgtcttcccagcccagtccaggggacaggatagtgcaatggtttccaggcccggccccagagcaccccagcccaacatccctctgccctgccaaggtcaggagtgtgacctcaggtggattactccatgcctcagtttcctcttcaaacaaggaaaacagtgggacctggttgacgctgatcctgcttagcatatgcctggcacagagaaaagccattgctgtgtgcctggcggtcctggtgtcatcgctcatatgatggttgtggatccccagtggagctggagcgtgactcccacacggcagacccatgagtgtgctggctgccagccggtgcctgtgttttcagcttggatgaggcctgggggccaggacgcacgctcctatctgctctttcccaacagcatgggtgagaagagagctttgcaaacagtgccatcaggtattatttccatggctgtccccacgtgagaatcacagaacacagtgctggaaaaaaccctggacgtttctcagcccagatggggaaaccgaggccccccagaaggaaaggctagcttgcctgggtcacatgtgcccagagtcccacgtgtgactagcagcccatggaggctggtggcctgtgcatccctgcagccagctcctgccctggggagaaactcctcctgagaaatggcgctgggcctcaccttcacgtccccacaaaggcctcacactgcttttgagaaagctacccttgagtgacaagagggtgctgggcaaccacatgtcctgtgcccaagggccaggactgcaagaagctaagcaaggtaggagccccgccggccccagctgcagcaggaggcctggcagcagatgcagctgtggatgatgaggccccaacccagcagatcggtcaccacaaacagttaactcaggttacgctgtgcacccactaactgcctgccaggcacccggtccagcctcctcccagcccaaggcagaaggcactgccaccctcctttatctcagaagggaaaaggctttgtcctcctcacacaggtgaatgtggaggtttctcccctgtgggagaggttggaaggccgaagccaggtctacatgggtctggtccctcattaccgtcagctgagggtccctgttgctgagccgaagcagcgagacctgccactctcaggtcccgggggcatttcccggagtctggccccagctgggcctcgaggccaggcccatcaccctccccgcccagcccttccaggcagctggggggagctcagttaattacatgtctaaatacatctcgaccatctcaagttgagcccccctttgtccctgcccccggtggaggtgggaggaggaagtcagcaactgtcacgtagggccccgtaagggtccaccagttcttttcttctcccagcccaaggcaccagcaaaaatactgctagccgttctgtttttgctattttacatcaccctttccattgtaagccataattttcagaggtttataggtcagctattaaaataataaacgtctcttttactaagagggagcgctttgaaactcggggctggtagggtggacagtgggggcgcacaggggtgcactcagcctcgacttcttccaccaaagcctggttatcagaagccacccctccccatgtcctcctgattccagggcacctcccccttgtgctcccatttctgcctcccctcagaggcttcgaggctgcccctcctccactgcaggtgtgactagaccttgaacactttgagtgtcttgtggcaagacctagggagaccctggcccacaaaaacaggagaccctggtgcaaggcctgaagaagtctggaggactggctgtgtcttggtggagccctgctccacaccctccacctcagcgcatcctcaaactagcaggggcttgagcccatcagcagaggggttgcgggtggtttccttgaaacaagcctgggtctgggcagcaagtcaggggctgtgctccctgcctcctggggctacatgaagtccaggcttgtctttctgcagccccgcaggtgagaggtgataaatgcagggtgcagtgcaggccggccgcccctcctgagataaggggactggagcaggtgggtgtgggccaggcccagccaggagagaggcttccccttttggatggactggggatgcccactttgggctgctctctcctgcgttccagctctccagcttttgggggtgcaggagaagggagctggaggcaggcacaagcacaaacagactggagttgcagcatttttcggcctctttatttagaacccggcggacgaggggccggggcagtggtacagacggctcaggaaccattttaacagacttgtcttcaagtttcagataaacacagtcataataagagagacagcgaaagcgcgaagagactgcaagctagatgggcatgtatggcagctacagcttgtgagtgacccccttccccagagtccgcgatgaaaataaagttacacttgtcaataaccagatgtgggagatggagagtgcctttggcataaccaataaccgagctagtgcgtggcagagcggtccacgcctggacataaatagaaaatataagttagtataactttaaaaactttttgtacaaatatacatggtttttttattttttccttttttttttcttttttcttttttttgcactgagtttcagcagagattaaacattttatataaatgactcttaaagctttacaccttgggaccagtgtaccttctcgtgcagaatacatttagatataaaaagacgttattaatacattgcacagttttcaaaatttaaaaacaaaaccgaacgctgctctgcggcagccgccgccggttgctgctacatgaacggtcccagccgaggcccagcgcccttccaacgtccgctgccccggcaggttccctcggggctctttgggctctaaactgcgaggagaggggcggtcagcaaagccggcggggacccggcgggtcggccctccgcgcccccccaggtgcgctgtactcacttggctcaccgcagcctcttgcgcggggtctgctccaccgagcccacgccaggggcggcgcttggagagggacacggcgcggggacatcgcccgacgacttctcaggcgctgatctcttgcgcttggcgaagaaatctgcgggcgacagcgcgcgcggccggtcagggcggggccggcccggagacccgagagggggccgggagagggcgcggggcgcgggccggccggggtgggggcgccgtccccgcccgcgccgaggtccgcggcgggtcagctttgtttacgtcgccgcgcaatgtgctgtgtaagcatttccccttgtcccgcggccaagccccccggggccgccgccgcgcttaaccccctccacgccgtgctcacggcgcccggccgcgcccggggaggggctcccgcggccgggggcgaaaactgcgctcccggggggtcgcggccgggattcagcctcccaccccgcccgcgcgaagccgctggagggcacaacaacggggcggggaggggggtaagggcgcagccgcgccctgagcgctgcgggccctttaatgccacgggaggaggcgggaacccagcgaggcccccgagggctggggggaccggccggccggacaaagcggggccgggccgggccggggcggggccgtgcggggctcaccggagatcagaggcccggacagcttcttgatcgccgcgccgttggcgctggcggccgcggtgccggccgcgggacgtcccgaaatccccgagtgcagctggtcagcgagaggctcctggccgcgctgcccctggttcgcgccctgctcggcgctctcttgaggcgccgcgtccggggccggggccggggcgggggccggggccggggccggggccggggctggggccggggccgcgactggagccggggccggagccggagccggagccggggccggggccggggccaggaccgcgaccgcgaccggagccgcgaccggagccgcgaccggagccggagccggggccggggctggagccaggaccgggactgggggcggggtggacgccggggccgggaccgggacactaggcagctgctccggcgcctcctcgaggccgtcgagggactcagcggccggctcgaggggcgggctgacagccaccgcgaccgcgacgggccgcggcgccagcagcaggcggcagcgccccacctgcaccgtctcgcggtagaacgcgggcaccgagtcgctgtccacttcggtccactgcaggcgtccagggccccgcagcggcatgtcctgctggaagtcgtaatcccagcggttctggtcctcggcgttcagctcggccaggcgggcctgcagctcgcggctcagctcctcgtggtccaccggcccgaagaggctgcggcaggcgctggtgcgcactagtactgggaaggtcccacgggcgacaagacgctccatcgtggatgtgctgcggagggacgcgtcggacatggcccggggctgcgcaaacgcgggcagcgagagaggagaggacagcgagaagaaggggaaaggagaggaggagagggcggaggccgggcgcaagggagaccccgcgccgcccgactctgcgtgtgcgagggacgcggcggctacctggctgtccggtggtggactcttctgcgtcgggttcgcctgtctcgtccggacggcagccgcgccccctcgatgcctgctggctagctcgctcgctcaggcctggccggcacccctcgagcacagcgcacttggcctgtggaacgcccagcccgcctgcgccccctttatacgcgcgggccccacccccgtgcgcgcgggcccggccgcgattagcataatgtagtattttcagtttcaacaacaccacggcgattggcggccgccccgctgccccgccccgccgcggcccggcccccgcgcaccgcccattggccgcgcgcacacccaccgggggcggggcggggcgcgcggccggggcgcgcggctgattggcggccgcggggcgagcgcgctgtagcaggggaagggggcggtgagcggggcgggggcgggagttaaagggcgctgcgggcggtaacgtgacaccgcgacgcccgccccctcgccccatcccccctgcaacactcccccacccccccggctcccgccccccgccggctcctttgtctgcaggcgggggcctcagcccagcgcggcaggggccggctcctggcgggtccggtgtccggccaggcccaactcgaccccggcccggtccggaccccggcgcccagctccgtcccgcgctcgcccgtgggcctcctgcgccagctgacgaggcttggacccgccgctgccagctcggccctggcctgcgccggatggggtcttcggctgcccccgcgcggcctgctgctgctgggctggtgtcccttcgagggctccgcgcgcctggagccctcacacacctgctggccctaaggccctcgagtcgggaggggggacaggggtcagctccactctttccccgagggaccatgtgtgggacaccttgagagactcccaccagccccctggagctggagtctgaagccgctatctgcggaggcccaccctgcccagtagatggaacaggggctgagcccatcatgtcactgtcgggggtcccagcccttctcagccttgggccagaccactccagccccgggatctgcctgtccaggctggctggaagctgttgtactgggtaaaagtgaaagatctgcccgaggtcataggggaaggggctgtgaaggaccatgcccctcccccgcctgcagcccttcctggtacagacctcggtcgtgcgcgcacgcacacacacacacacacacacacgcacgcacacacacggtgcttcaccccagccaggccagaccaaaagagaccattatttcctgctgcctcccttttggcccacctaccatgaggcagggagccccctcctcaaaccaggagcctcccagatcgggatggggactgtcagacacctgttggagggtccagcagcccatgagatctaagcccctatctcaggtgagcctgtgagccagcagagagacctctgggagggagggaaggtgcggtcccctgaaccccaaccagcctgcctttgagtcccaagacacccccacccccatggaatgctgtggcagtgtgcagctgcagctgggggagcagggcgggtcttctgggtctcagggaagcgagatctgaagtgaggggggtgaactggatgggacagggcgttaacccaggagaggggccagggccattcttggctcttgatggtggaaccaaaagccatgatttatgtgcaatttcatattcttctctgtgcacaatttacaaatttcccgcaacaagcccagatgtcacaattttcatcttaggaaaacaaagagaagctgaagaaggctccccaggccctgcgaacccctcaagcagggctcatatcaactggcctgggggcagaaagaggcaaagtctagtctgctccatgcccctatgctgccacctccccagagactaggagcaaagggctagagtgggtagtgacctagaggcccccggatacccacactccaaccatcaggactcattggccttggtgacaccactcagagggtgtagctgccatcatcctgtgttatagaagagcagcagagaccgcgtcagccgctgaggccgcacagctggaaggaagcagggctcagaactcccgggctgcctggctttctggtttggtttccacttaggtttcctacttttatttttccactttaccagcttaattacagagtcaaacccagtgctgtggggattcctccgtcttggcctcgttagaagctgagaggtgacctgctctaagtctgtcactctgaattcgatcaaagatggtacccaatagcattttaaacctgcacgtcccaggagcggggctgtgtccccccagcccaagccagggacacacctggaggaaggcaccccaggagctgggggctgggagttccaggctctgagaggaggcccaatgggcccagaagcaagcaaacatctgtctaggtgcaacaatcaagctctatttttgtaattaaaaatgtatccaaagggaaaaaagaaacaaaaggaacaatatttgtactctatgttgctgcagagagcagaactgcggagggggtgctagtcccaaggggtggactgtgctgtgctagtgccctaaatcctgcaagcgcggggttgggggggcgggggagaccgctgtcgggggtcgtgagttccgggcccttgtgtgcatgttcacgtcctgtcattcttgcccccagctgagagagcagtagaggaaaggcactacatccaccagcctttgcattctcctcggagcacacagaaagacattttccagttatcttgcacacaagtgggcggcgggacccgttttggccgggaacgttgtcaggaacgctgtacaccacttccaggcggtcacgtccgagctgcccaggcagtccttctgcgccctctgctggccagatggaggctgcagaccctgcggggccatcaggagagaaccaccaagcaccctctgcacaccgcattgcctgtgttgggcacaaagaataaacttttattgcatcttaacccactagaaatgtaggcttgtccatcacagtggggcgttacataccctaatacatagggaaggcataggtagatttcagttggccttttacagacaaggaaaccaaggcttgagaagattcaaaccttactgcagccatggctcacacctatataccctcagtactttgggagaccaaggcaggtggctcgcttgagcccaggagttccagacaagcctgggcaacatagagaaaccccatctctacgaatattttttaaattagctgggtgtggtggcacgtgtctgtggtcccagctactcgggaggctgaggtgggaggattgcttgagcccaggaggttgaggctatagtgagccgtgatcgtgccactacctctagcctggacgacagagcaagacgccctctaaaaaaaaaaaagaagaagaagaagaagaaagaagaagaagaaaaagaaaaacttgctgcccaagcagttaaggcaggattaacctgcagccctcactgctgtgcgttccttctaggaaagacccagaagccagagaagcctaggtcccaatcctggtggatcttcgtgctggaatcgttaagccagctgtttcccaggggccacccatgggccagtcctcaccacaacctcatgggtggtcggtcaatgtcgtaggcccgctttacagccgaggagacagaggcttccagaggcaaacacactggtccatgagtagcagaacgagggtaggcccaggaagccatgtccttggccacatgtgctttctggcgggtgacctccactccagtgcctccccggctgcccgaggcctccccttcccgggtgtggcagctgtacagctgccttgtcggcatgttcatggccccatcaggaatgtgtgccgcaggtggcttcacagggctaggaatgcccgtcctaggttaggcccaatccctacccagagccccagggaacccaaattctgggacacaggacacccggccagtgggccaatggcccctatcagggagtgaccaaggacaggccgggagctcttctttcccctctgacccatggtgaaacctgcctcgggcctgttccctgggttctgaggccctgagctatctgtcttcaaacaaacgaaggcctcaaagaatgttccattgagccatgggccccatatcacccatcaatcacaaagggctggggattgcaggcacagggtcaaggtgggtaggaggtgagggctggacaccatctgaatctgtgctgttccagggcccactagagagtctccaggtacccggagcctgccctcagcagtaccaccctcccacagcaccccagggaccctgcaagaggtgtctgtgcccttcccggctgcctccccagctgctccccaggtggtgccctgtggagaggaccagagggatattataaacaatgacaacacttgctgccttcatcttgtgcctgctcagggccctgccctaacccagggctgggctcgttgcctcatttaatccttccaagacccctgagagggaggtgtgttcgtgcccattttgcaagggaggggactcaggctcccagaggttaagccacctgcctgaggtcactgagacttgaggttggccctgcctttcacccagcctgagcccctccataggacttctgtgagggcacaagaaagcaggaaaagaaagaagtcaagggccctgggaatctcccctgacatctcccaccccaagccctagagccagggctgggcatctgtgcagggtacaaccctgcccagggatgcctgactctggaaaggccacccctttggcctcaaaccacatcacccagcagcaggtcctcagaccagccctggacaggagcttgactggctgtgcccccaaaggccccagagctccctgcccccactgagcctccaccttcccatccataagatggggtggggagtcatccagcccagaggccccaggggcatggggagtgacagattaacccaaggccccccctcccgcaacaggcggctcagcacacacttggcggggggccatgctgggccaggagagctcccccgcaccagttccccgcgcgcaaggctcgccccgccccccaggacaggctgttcttggggcggctgccaggcacgtcctccgcaggtgccggcctccctgcggtgacgtggccacatgcggcacaagctccgattacagggactgccttgtgctgggggttccggccaggggtcctcactccccaggaaccgatgggcggagctgggcaggccctgaggagaggcccagtgggaatagggaacagtcacccctgctccagaacgggaccaggggctgcttcccttggggtctggaagagagggaccccctggtcccagcctgcctgagactgctggtttcggcactgaatgttccaggaaaccgagggccactggtcatcgtgggcttcacacggcgcctttctgggctaggaagggggctcccgggctaggaagcaggtaccgaggagggtctcaaggacatgtggggacctatgtcagacacccctgcagccagctctgagcccaccaggcctttcctcctctccctgccaatccacaggacacagacacaggggtcccaggcccagtggctcactttatcagggaaacagcaggaaaaacaaatctggtgtgagcagatctcccttcccaccaagccccctgacttcctgctggagctcggggagacccctgtgaccagcatctcctgcctacggggggcgccagggcctcaaagcctctccaagccactccctcccaccctgctttccacacccaagccacagcgttcagagaagctcagggcctatttgaaatgccagagagtggggatgcctccagagaggtggcatgagggcccccagatgcaccccaccactccctcctccactgcaggaggaggggcctgcagttactgaggaagcctcacccctactgggccctcgggggtgaaggggcttcccaggccttgagggagactgtatttcagatgtcagttaaaagcgcctgctacatggcgtgacctctctgaatcctattactttcctgtgcaggaaactgaggcccagagaggtggagtgaccggcctagggtcccccagcaagtcagagacagtgaagccacctcctgccctgggctggggtcccgccccactgacctccagggtcagagaaggaggggagcccccaacacttaactccttccttctttccttcattccttcctccctcccattctccacctcctcctggctgagctttgaagccagggcagttggccagaccgagcgcagaggccaggaggtgacggcaggcttgccctggcggcctcccaggttaacacactcccaggtggctgcaccccacaggcgagggctgctcagagtagatgctcaaccaagaggttgcccgtgcccccttccccagccgcaggggcagccagaagccaagcagcctcccgcccactggagcctggagcctgagggctgaagctgggcgcctgctgccccctggcgtcccgaaacggcacagccaccaggacccccacccacctcattcatgcctcacacctgggggtgacttgggccagggccttgctctctggccccgagtcccctcaagtgtaagatgggggctctgcccagtgtggctgtccgggctgcagcgggcaggagcgcatttttcacaaaccccaacacccctcggatctgggggtggggcggtgtcactcgcacctcagtgggaaacagcacgtgggcctcgcccgtctccagggggtgggggaggggagacaaagagcccgctctgcggagaggtgggtacccgccctgccgcccctcccccatttcctctctgctccccctgcccctcctcccctccctcctccttccttccctcctcatccccagctcctcctcttcctcttcctgccctatccccccgcaggcccggccggcagcccggcgccctctgccttcgttcccgccattggcgctgctgcccggagcccctaggtgacagccagccccgaggctgcagcctctgtgtcgggcctgcacctgcccaccgcgtggtcactgcctgggcacgtatggacactcacacccttcagtcctgagcacaactgtgccctggctgcttcggaacaacaaggaatcatagtcctgcttctggctgggagctgggggccagcaatcagggcagctggggaagtggttagggaggtggcggcacacaggccgagctcagagagtgagcagagaatgggcccaggggagggcgctggagagggctgcagggcttggggctgcagctcaggagctggcttcaccttggaggctatcagacctgctcctcagcattggcccagcaaggggaacagtatggggaacaggggacaggcactgcctggccagcagcaaacaagtaggctgtggagttgggcagagcatctgcctcttactagctgtgtgtccttgggcaagttgcttaacctctctgtgcctcttctttctcatctgtaaagcttctgatgaggcttaaagggcaagtcagtatgtgcctggcacagcggccttcctcttgaggatgccactaccctcaccatcatcagcctctccctccaacctagaggggcaggcagggcagagagctgccactggccacccctccagctgtgctgtaatgaaaactggacattcactctatacccagagatgtgggctggcggggaggaaaggcacctacacccctgccatgtaaacaggcaggcagggtgaaaggggtttggtttgtttgtttgttttttgagatggagtctcaccctgtcgcccaggctggagtgcagtggcacgatcttggctcactgcaacctccgcctcccaggttcaagcaattctgcctcagcctcccaagtagctgggactacaggcgcctgccaccacacctggctaatttttgtatttttagtagagacggggtttcaccatgttggccaagctggtctcaaactcctgacctcatgatccacctgcctcagcctcccaaagtgctgggattacaggtatgagccaccgtgccaagcctaggatgaaatgttatctacatgatgagcagtttgggcagtgaaccccacctttgtcagagttcaggacagtccatgggatacaggtcactccgactctcatgcatcagtcttcacgccagccctgagtgagcactgaggcacacgtgcctagcacccagcagtggccccatcccctagctgctggtcagtaccagctgccactgcagcacaccctttctgccaggcagcctcatgccatgcacttgatgtgcaaatgatcttgtctaatcttcacaagcatcccgtgaggcagggattaacgttgtccccatttcacagatggggaaactgaggctcaagagttccagacccaggcaagccctggtcagtggtgaagatgccagcctggtggggctggctgcagagtgctgggccctgtcataagcacaggcctctggcacgcatgctgactgctggggattttaagattggggcccccctgctgagccctatctacagctgcccccttccctgggttaccccaggttttaatttgaagcagttagtgaattgagcttatgtggggtcttatttgtatttgcttttgggtttttgctttttgggggagtttttgggttttattgagatagagagtctcactcttttgcccaggctggagtggagtggtacaatcttggctcactgcagcctccgcctcccaggttcacgattctcatgcctcagcctctcaagtagctgggattacaggcatgcgccaccacacccagccaattttttgtatttttagtagagacagggttttgccttgttggctgggctggtctcaaactcctggcctcaagtgatctgccagcctcagcctcccaaagtgctgggattacaagcatgagccacctcgcagggccctgtatttgggtattagccatggcagcctggcagatgttgctgagggtgtctgggcacctgggcctgggcttggcggcctgagcagtgcctcctcctcaaatgtcaaattgaggcctggactaagggtgtctgatttatggcctcacctgtctgtccgtccattcagcaatatctccctgggacctcaggggcaactgtgccttcaggggcttccgggtgggcaggcagaagcagaaataagtatacaaggcagggtggtgcccaggttgtatgatgaaggaggggacgggggattttcagggcaacgacttgtgccaagatccaaggatggaagggaagagacgtacaggcaaggggaccattccaggcaggggacacaggcagagacccatccaaagatgagtgcagggcagacagtgcttgaagctggagctctctatctctcatgcttctttggtttgcaaaatgtggcatgatccagtgggggctgaggggccagggctccagggctggctgccccaggaacacagcagtgtcaccagaggtccagggtgggaaccaccagagttttagaaactcacccagccatgtccagggtgcctggagcagggaagggaggctgctacacctcactgagatgccagtgtggctgcccccggtggaaaccaaatagccaggctccctgaagctgccagcaagtctaggggcagggaggacaggtgagagctgagaggcctccaagggtcagaagtaattgcatgggttttgcgacttctcctcttgcttcttggaaatccttcctgcttctttctggattccctactgaattctgaaggttctaaaagacctggaggctgggcactatggcttatgcctgtaattccagtgggaagatcacttgaggccaggagttcaagaccagcccaggcgacatagcaagatcttgtctctataaaaaaaaaaatttttttttaattagctgggtgtggtggtattcatctgcagtcccagctaccagggagactgaggcaggaggatcacttgaacccaggagttcaaggtggcagtgagctatgatcacaccactgcactgcagcctggatgacagagcaagaccttgtcttatgaaaaataaaataaagagaacatggatgtgggttggatggtgagagcttggggctgtcctttgttcctgggtgggggaaagggactgggaccaaaggaggctgcggttgagggagacgtgtgtacctaagagatgggcagtagctaagctccaggccctcgggcaggtgcctgtggggggacagaggcactggtggccatgccacccatcctgcctgagtttcccagttctggctggtgagcaggtgtgaggctgctctctcaggaccccgttcggaggcacatctcttcctgatcccacgatgcccttcacatgcacacacatgctcacatgcacacatacacatgtgcacacaccccaccacagcccttgccagcctgggaccgccagctgctggctcctccccctgcctccccggatggacatccgtcctttgcaagggctgttcttccttcttccttcttcctgagtcctgaggtcgggcaaggcatccctcaagggagtccacaggttgggcccaccaccccgcagttcccagttcctatgccattgcctggctacctccccaacctccaccatcgtcccttcctgcctccaggtcaaggaccggagagagtccctctggcctccaagggtcctatgaggggagggtgacccagtttgtccggagctgtcccaattttggcatgggaagtcctacatcccaaaactcctcagtcccgagcaaaccaggtctcccccaagcaatgagtgagcttcctagagcagggtcccagctccaccacccatctcctctggtcccttggcctgtggtatgagaaaggggacgtgggctactccagactacactctcactgtcccccaaaggcctcaagggctccagtcttcaggccccacactggacgcctcccccatgctgccatctgggcctttatctccttcagctgtggctgttggccagcgtgaacacaaatacgtgaaccacagcccaccatgttggagccccaggtccaggcccacagtggagcccagtgaggggagagtgctcacccatccaggaccacaggactctccccaaagcccatagcacgttgctgccctccctccatttggacactggtgtcagggactgggcccttggccctaagcccgtctgggttccctggttcactagaggccagtggagaagcccctgttggcagagcctcctccggggccctggccctaaaggccacaattccacacacctctcatgggatgtgtctgagcccaatgcccagcccggcaagaaccagccctggatgaggtccagcccctgcccctcctcctagaagtctctgcccaacctccaatcccagaagcgcattcagagtccagttctagaaggttcctcagcacctgacagcccacttcctcacgtgcacctgcacagccggggcctagcagatgagagacagcatgggcaccaccaggccccccgcagggctacctggcaagcctagcccctttgggctgaaggctgacccctgggtcccaaggataccaggtcagggggtgaaggacctttgaacccagcctcccagactcttaacctgacacctcccagatgaagccgaggccaggcacccagtgcccacagcaggctgaaggcccctcataaggctgtgattcccaagacaacacatacaaagcctggggtgctgggacagagccccagcagggtgtcagacacagatcccactgtgggatccaggcagcccccattgaccaaggtctgcaaccgcacctcacctggctgagaaggtgtaaggtgggcgggaaccgaggttcgggcgggcaggagtcacatccaaccctgcctccgctctagtcccgccccaggcaaaaccttgttggctttattgagacaggtccttggagaatcataggagtaagagtacaaagcctcaaggagaacacgttcacttcacccatggagtaatggcgaaggccagagccctccccgctccttccagatcacccttctgtcctctgcagcatcatggagtaatggtgaaggccagagccctccccgctccttccaggtcacccttcagtcctctgcagaatcatggagggatggtgaaggccagaccctccccgctccctccacatcacccttccgttctctgcagcatcactcttttaaatcttaaaattgtaaacaaaggttctctctcttcatcccacttcccctccagccacagtcccatttctcagcccccttttggtgcaaaacccttcagaagggtgtccagcccattcctcctgcttgaatcccgagggtcagcccccatgctcatgacgctcttgccaaagccaccagtgactccagctctcggccccagggaagctcccaggccttcactcgcttacctgcctctctctccagacccagctcctttatttttccctccctttccctggtcagaaccctgggcacctcctcctcatgctggggtccagccttggcccttggcccctctcctctctagccccatccactcctggtcatctcatccagggtgggagctctaaacaggacatgagtgtcaatgacaccctcacgtccagctcagaccacatgccgcaaactgcacactgcacactctgccctctctgctggcccacaggcccctcccgtggatggacctgcagggttgcctcccctcatgtcgcccccagccgcacctgaaggccccctcagttggccctctcagcccaggccccaaccagcaggaagcctgtcaggcctccttccagggaggttccaaacctgcccctcaaatccccccatgccccatccaagtccacaccacctctcatctggaccacagcagagacctcctgcactgcccctcccctcaacccctcatcagcacatcagccagaggctccttggagaacagaaggggctcagaaccctgcagcggcgtccactgcacacacaggaagaactcaagtgctcataggcagtgagtcatttccttaggcattgtggtgacccgggatcatgtgcctccccgaagcctgcacatgcactctaatgatgcaagctaccaccaggcggtcagctttgccagctgacgtcccaaacagctggcatggggcatgcacacagtaggtgcttaataaatgtgtgtcgggttaagataggcccaaagccatttcaaatgtccaggcagtggtgtaggcaggggtcagctctgaagctggcctcctctcattcgggagacccctcagaggtcccagcctccaggatgcagtgttcagagcaatacttctcagtgcacgtctggctgtgtccctgcccagcgctcccagggtcacccctctctctagactcactttctgccccgtcaccccactgtacacccttggtcccagccccttccagtggctcagcttcctgaacactccaagcctgggctcacctctaagccgttatctatgctattctctcagccaggatgcccttcccatacccaaacaatccgtgctcacctttaagactggctgaggcatcacctcctctgagaagccacctctcccaaacctgagcccagatgagccaaagcccttccttcctccagtcagcctggatcctctcatccggcagaactgtcgccttgcttctctgaagcggtgaatgccctggggctggggacgcacaggctcgctggcccacaaccaaagccgcttcctctggaggaggaagtccaggggtgccagggttccacttgctttcttcttcacccagcctaaagggcaattttcccacattccctcagaaccaggaagttcccccattcacactgagcctgttcatgacaaaaaaaaaggtctctccgatttcctctgctcaaccagttccctggctacctgaggccctgcttcacctggaggaagacagtggtaagtttccagcatctccaccacacctcagcgccagaggaccctcagcctccctcgcacacctctgggcagtttggtaactcatcccatctcctcctgccgcttcatcctctaagccctccccagggaacccaggaggcgtctggaacctgttggggacagtccctcacacctgccccattgagtaagggttcatgtggatgcccatcctcccccaggagtcccaaatctaagacactctgagactcctgtcacccacccccaccttacacagccggcctttctgtgcagtccttccaggaaactctggctggacctgggctctcggcttgactgcactctccccaagtccccagggcggccagtggtgactattcttgaaaacgagcttggcagaggatctggggacacgcactccagatgcaaacacgtttgcactctttgggctggaatcccctcgagcggtacactgcacccgtgggcttgctaagaaaccacctcacagagggcagattgattggacaaaaggcatttggtccccaaattgattgacgtgtgtgaatgggagttttcagaacaaagacccaaagatatgggggaaacaggctgggcgcggtggctcacgcctgtaatcccagcactttgggaggccgagggggggcggatcacgaggtcaggagatcgagaccatcctggctaacacggtgaaactccgtctctactaaaaatacaaaaaaattagcgggggctgtggcgggcgcctgtagtcccagctactcgggaggctgaggcaggagaatggcgtgaacccgggaggcggagcttgcagcgagccgagatcgcgccactgcacttcagcctgggtgacagagcaagactccgtctcaaaaaaaaaaaaaaaaaaaaaaaaagatatgggggaaattgccatttctgatgcttaggctcaacaaagtatggacatccatgcgggaacacagatgaaccaagggacctgcactaatgctcctggaccgcaaggggaagcgcagcgagggctgttggtctagatttcttgaactttctgagcagcattccttccttctgggcatggagcaggaccctcctggaatggggtcttatgccctacagtcaaacaagagaggtcagataatttatggccagcttctaaacacaaaggtggagggaaagttagagcaatatttttaggtttgatgtctggctgtgtggaaaggcggggttctgatttctatgacctgccctggggaaaatggattccagtttctaaggccagcttcggggaaaatggcactgagagacaggagagcaagagaaggtcagagaaacactttttcttccgaagctgcttctgaggccttcattttggggtattgttttctgatgcccaacatatctgagctgctgaacgaagggtagctgctgaaccactcccacggtgacttggaatggcttagccagccggccttgggccacctggctctggcccccctgcccaccaggactttggccggctctcgctcgcctctgcgatgtccgtcccaccctgtctcacccctgcagttttctgctctgtggagcgatgattgacacatggcagggggacactggttttgacatttgagcctgtgcccagcccttgcctggggaggaggtggggcaggagtcctgaatgagcatctccctacttagtgacagtcaggggcacggagaatggtgcccaggccaagggcagggcttgggccaagtgtgcgcagcgtggggtgtgtgtgctccagcggctcctgctgcggagggcggcatgaggcttgtttacctgtgtgctggcatctctggtggcccctgcaagggtggggaagtggcaggcagggtgaaatggggaaaagtgggctctcaactgctcctagcagcctccgggtctggggagggaagtgaggaggggcccagagctgtctcctggtcactcttctggggctctgtgcagacctttggcagggccaggctacaccacaccctctacaacctcccctgacttcttcccctaacccctcaccaccattcctccgcttttctctccccgcccctgcctcccctccattctctccttccctccacctcccggtcccatcccctgcccacactgcccctcctcaggcccaaagtggacaccggtgctgcctgagggtcagagtgtccacctccagcagcccgggcaccgggcaggattcaagctggagggggctggggcgggcgaagccgggcacggggcgagcccgctggtgggcggggcaggggcgggtccttcgaggggaggggcgggctcggccagtgagagcgcagaaaccgtggcacgggcgctcccggaactggcgattgcaaagcgcgagggctggaactcagacccagaggggcggtccctgttgcaagtcatctcccgaaagggcggggccggggctcatcccggaaggaccggtgtctaggtcaccctggagcgctcaccccaccggcacccgtgcccaagcccgcccctgcaaaggcaggtactcgagcacactccggagagggcggcctctgagccccgaaccccgaactccggcgcagcgtcgcacctctgcccaatgaggtgcccctgacgtgcctgctgcggctgccctgctccccccagcctccctgcatcccgggatgggggagggcgccaggcgcagctcccggaccctcaggggtctccccgccctaccccaccagcctgggttcggtacctcggggctcagatgtgcagtcagctgttaatgtggcaaaatttggggaagtcctctgcagccgcaaaatccagttcccaccagttggaggccgggcggggaagggtggggacagacagcactccgctgtgggaggtaaggcagagctactggggagcctggaaggctgagctatgtctcccctacgcaagaccattccagaagccccttggagctctggctgctggccacaggggaaggtagaccttccctgagagctgcactgtgttggggacagggccactgtgggcctacggagggcctccaggcacagggacccacatcagccctctggccacagaaggcgctgatgatttgaggtggactcagccaccactccgagcctctgcctccctctaaaagtggggcatggcacattcctgtgtcaggcaaccaggcactgagcctggcccacctgcaggggtcggggggagcagcttgtccctgtctcccctccccgggaggctgtgtgcctggagaccagagctgtcaaaagtggaggagggggaccccctgatgtgtcctctaaggtccaggtagcaggagagctccactggggagggggtcctgcagtgctgtcctctcttgcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccagtgagtaacacaccccagcccctgcagccccagccagggctgaaccgctgttcctcctgccctccatctgggccgtcgcagagagtgggggtgggggtttcatgctgccagggcccctcccagttgggactcatgccacgcttaagctgagtaagttaaggactctgcctctggacccccgtcagcacatcctgtgctccagcttcagtgccagccccgggagaagccatggggagccaccccacttccctcctgggggcagcacctcctcaaaccttcctagcgctgttcctcctgcctctcacccggcagcctttgccctctggagtccctgccccaagggctgttcaatccggtgtggctctgggcggatcacccctcagagaggctctccttgcacctgcccgcagcttctatctctcccctccatcttcttgggtccttgttgtccactaaatgatctgtggcggcaaattgatctcaagctttttcttgcaagagatagaatgctgtcttattttattatctctgttgccaaatgcggaaacatttcattggcaaattcatgttagtttagtgtatcattcagtagtctataccacagtgtgtggctctggaagctgtaatagtaatgattaaattatattcaccaagtctggagaggcttgggaacaaagtctcacatcaccaagaagctcaggcagagtcagggccaacctcggcccttcctgtgtttgcttctgggaagcccggcgtgcgtgggctcagacagctgccctcctcctctcagccctcagagcctggacctgggcatctaggcgggagtggggatgggcctttggcaccattccgggcctggcagaggctcccagcccgagggtgagcctaaggatccctccccgccgtgcctcaggcgccccgcccactcctgctaaatggctggggccaagccctgaatctcctccctacccgtggggaaggctgggcaggagccttgcttttctcatcataaaatgggtaataacagtccctccctgtaggattggtgcggggaagagtgaatgagaagtcagaacccttcccacagctgggcacagagcacaggtggagtggcttcagccacccatcgactctcatggggagtaactccgtgctgagtgcccaggagctgaccctgatgtcagaacctgaaatattgcagagtgtaaaaatcctcaacagcccactccctcggagctgggggtccacacgcacaggggctgcagtgggaagggggcgaggtcttcctcatagagaaggcaaccttggagcagggctggaaggaagcaggagaggccccggggcagtggagagagcagagtggctagagtggaccggttgaggccagaatgggaccacaccccacctgctgctcaaagaactccgggctggtgatggctgtggaggaggtgagaggtggctggattttgcatgtgttgtcaatggactgtagtgggtgtgagagaaagcagggctcagggagcactgaagatctgggcctgagcccataaggaaggaggcatggacaggaggagagggaaagatgggagcccagttggggacgggttgagtttgagacgattttcgaccccagtggagagccgaagggagctggacacaaggcagttcagcacagaggctctggggccctgcagcatggagacggtcatgggctgggctcccccagagggcagggaggctggaggtcggatgagctgggggaactggcagtggtgatggaggaggggcaaaggacccagcacagcccagagcagcagaccatcgtggaggagggaagaagccacgaaggcaactgtcactccagtgggaggcctgccaaagcggaccactggaggcagcagtgtggggtcaatggggacctcagggagaggggagacagcaggaggttttttgtccttgcaatagtttgctcagaatgaaggtttccagcttcatccatgtacaaagcacatgaactcatccttttttatggctgcatagtattccatggtttatatgtgccacattttcttaatccagtctgtcattgatggacatttgggttggttccaagtctttgctattgtaaacagtgccgcgataaaaatacgtgtgcatgtgtctttatagtatagtcccctggggcctgctccgagggctgggagagaaggaaagagatggaaagagaggaggctgcaaggtgaggcagctgctcagagctccgccctcaaatatgtgggagtagctgtaggggagggtcaagagaacgcaagagaagtaacaggatgtgagcatgctccattgccaccccctcaaaaggggattgtgcagagaaacggggagagaggagcactgggagcttggtccagtgggtgcccccacagaaggggactgtgcagagaaacggagagaggaacattgggagccctgcccttgaggaggcaaaaggttgggatgtgacgcaggcagggaggatgacttgggtaggcgaggacaggtgggcaggcttggggatgagaaactcagcatcctctatgaacagacacttctcaaaagaagacctttatgcagccaacagacacatgagaaaatgctcatcatcactggtcatcagagaaatgcaagtcaaaaccacaatgagataccatctcacaccagttagaatggcgatcatgaaaaagtcaggaaacaacagatgctggagaggacgtggagaaataggaacacttttacactgttggtgggactgtaaactagttcaaccattgtggaagacatgtggcgattcttcaaggatctagaactagaaataccatttgacccagcgatcccattactgggtatatacccaaaggattataaatcatgctactataaagacacatgcacacgtatgtttatcgcggcactacctacaatagcaaagacttggaaccaacccaaatgtccatcagtgatagactggattaagaaaatgtggcacatataaaccatggaatactatgcagccataaaaaaggatgagttcatgtcctttgtacatggatgaagctggaaaccatcattctgagcaaactatcgcaaggacagaaaaccagacaccacatgttctcactcataggtgggaattgaacaatgagaacacctggacacagggcggggaatatcacacactggggcctgtcgtggggtggggggaggggagagggatagcattaagagaaatacctaatgtaaacgacgagttaatgggtgcagcaaaccaacatggcacatgtatacatatgtaacaaacctgcacgttgtgtacatgtaccctagaacttaaagtataataaaaaaacaaaaagagagaaaagaaaaaaaaaaagagaagctcagcatcctcacactagcggcgctggggaggggagggatggaggaggcagaggtttactaggggaatgtggggtgattgtcaggtcaagctcacaaacaaaggagagatctggcagacagagggctttcccatcctcgagggagcagggatggagctgaaggaagaaggagtctggggttggggatgggggggttaccgactgcccttgggactgaagtgctctggggagaattcgtgtggaccaagggggacagtggaaagaaggggagtgggaccccaagactgagcttagggaaaggtccaggggagggggcgggggcggtgtattagcatctggggctgccataacaaagtatccaaaaccctgggggcttagagcaacagaagcctattgtctcacagtttgggaggccagaagtctgagatcaaggctccctctgaaacccacgggggaggatccttcccacctcttccagcccctgggagcccagacatcccttggcttgtggccacatcactctgtcttcccatggatttttacaacgtcatccatccgagtgtgtctgtgtcccaaattctcctcctaatgaggacacgggtcacattagatcagggccctccctcatgtcctcactgtaacctgattaaccccatttcctaagaatgtcacattctgaggttctggaggttaagacatatgaatttggggggtacacaatgaagcccataataagttacatcactggaaggagagtcgggaactcagaggcaggggcagggggaggagcggctgcagggggaccaaatcacagagaattagggcaggatataagggtgtccctgggagggatgctgtcatggacctactcctccggaggggctgaagggctggggcctcacagagcagactgtgtcctgctgggcaatgggccacctcttggaggtcacttgggggccttgggacaatctgttgctggccaggacactgctgctggcgtcccccacaaagttttgaatgaatgaagacaaaatggtgggggtcaggtgcctctctggggcgtgcccccagaggggaaggaccctagaggccaccctgggctcccgcctaggagaggagttgcaaggaccttagagaccacaacaggcttccgcctaggagaagaggagcagggtccccctgggaagggcccctcgatggtcatactgtgcagtcaacagaacccaggccctcggtcccctcccaccccctgcccatccagggaccccagattctaggccctgcagtctttcccagcccctcccccgggctccctcctgtgtttcagtacctgtctcggaaactgggcctggattccattgccttcggctacctgcaaaccaccttcggggtgctgcagctgctgggcgggccggtatttggcaggtacagtgtgtgtgtgtacaggggctctccccacagtgacccaggccccctctcagacgccatgggctcagacgggccaggttccctgaccccacaccggacccccctgggatgacggcactcctgtgtcacaggccgatgggggtgcagaagaactttggcccctggtaggctcccgggtgtcccacccacgccttccactactcctgcctgtggccagagagagagtgtgactggtgaacacctcgtggctgtaagcaccagcccgtaggcctgccgagaccaggcaggagggactttgggggctccatacaccccgggtctcagtgctgtgggaacactgagcttgagagaggacagggacatcctcccacaagccacagcagacaggggagcaagggacacgtattgggagttgcctcttcagagcaacccgtaggcagaaatgaagggttccgcaggcagcagaccagcagcgatctctgggagggtttccagtggcccagaacagaagggagaaaggcgctgctttctcagacccaacctgacaaacgccttctgtaaaacgcgggcccaccctttggtcccctgggattccaccatttatttttacacggagttggtctttgccctgggtcagactcccagctcagtgaagctgtctgcgcacagccccactgggacgctggggaaactgaggccctgagaggagggaggcctcccagcagccgcccaggcgcccccgccctccatccccatcccgcactccagcctccctggtcagccccgcctgggcagcccctggacggggggaaggggacactgaccgcctccgtgagggtccgacccgcccctcggcccccaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccaggtagggccggggggactggagtccaggtggggccgggtcgggggcagcctgcggaggacccgggacacctccagggaggtctgcgtgcgcgcggggtctggccctaagggctggacgggggtggggggcgacgtggggcgtggcttgtggaggggcgggtcagggggggaagggccccaccgaggggctttcgccgctcagctcccccgccccgtccccagccgcccagatggtcatcacggacctgtcggcacccgaggagcggcccgcggccctgggccggctgggcctctgcttcggcgtcggagtcatcctcggctccctgctgggcgggaccctggtctccgcgtacgggtgagtggtgggggccggggcggagtctgtgggtcaggacgcccgcggctgggtcggccccgccccgcctcctcttggcctcggtttcctcttttgctcgtggggcgcgagtggccacgtgatgtggctactggggacgtctggccccgcgcgaggcctaggcctgacctcccgggctggctggccctggatagggccaggtgatgtcccagtgctgtccggggcgcgactggactgccaagctgtccacgcacagccccactgggacgctggggaaactgaggccctgagaggagggaggcctcccagcagcctcctgctggggacaggagcaccctgggactgggatgctgtggcagcggggctgagctgttggacggtgcccagagcacacctccctctccggaggtctctagggctgtgctgccggccttgtttgagtccccgaacgttctcccagcattttcactggagcctgggctggggactgatggctgctgatggctgtgagcaggaggtggagtggggtggggtgggtagtttgaacacctcaacattgcccccaggactctggttctagaatacagcggcagacaacacaggctgagtccctgggatgaagggaatgtgataggaattcccgtaacatcaggctgagctacatggagcaaaaagtcacaaagtagaactgggggctcgatggatgggatcactagggcctgtctgaggaggcggcatctgagtcgaggcctgaagcaggagagggaggcaaagaaaccacggtgcagaggccctgggtgtggaagccagggggccgtgtggctggagggaggaagaaggggcaggcaccaggccggggtgccctgggtggcacagcaggggtgagaatggggggtgagctcccctgcagggagaccggtaggacagccattgtgccggccgaggtgggggaggacagtggctggaccagaggggaccgtgatgagagaaagcagagggtagattctggctgggttttgccagtgggtgggatgtgggtgggaactcaagatggcagtgccaaggccgtgcctgaccctggggagcctggcgccttgcgcagaggcccaagcagcctggggtgccactgggatttgggtcttgttcaggcccagcctgggtgcctgtcaggcactccagggagctactgagtaggcacccagataagggggagaaatggggtgcatcttcaagtgtggatggctcggagccctgcgccccccagcacttcatgtttcggggctgggaggtgaggagggagcacgtcctgggagccaagggccactggatttgtgggggtcagggacccgtgcctctaccgctggtggccaaggaagccacagtggcccaccatctgcagcagggaggccaccccagtgctggaccagcaccaccccctcaagtcagtgccagccgcagaagcctcatgcaatagacggatcaagggaaatggggagaaaagagagggggtcgggaagtcgtgctataaatgggggcagaggtgggtccaggaggctatgctcagggtgggaggagccatggggaggcgccccagggagagggaagggctgatgtgggagccaagcacactgctgggagggtgtccctggaggatggggcttagggcacttgtgtgggcagctctggtgggacagcagggacggctcaccctggggccagggggctggcaggtgtgaggtgtggggagccggcaccacccagggcctgtctctccagggtggccagggtgaggaagggcgtgaggagggcacggggaggagcactgggccccagcaggtggctgagctgggcggctgccatcccagggtgctgcccacccccaggtactctgccggctcagggcccagccgcctgctgccgcctccttccctggccagccttcctcacctatgaaatgggccctcccctgcccttactcacccacaacgatgctgggagggtccgagctcgctcaggcagtaagccgtggccatggtgctggagcagctcagcacacatgcctcctgcaggcccgtctacgaggccacaggtcccctcctgtcctcacctgccctttcccccatcacagctgctgacccagaagacaccactcatgtccctctccctcccagtagctgccaagacggcctctacctctgcccacacctgccagaacattccattcgcttccctgcctccattcatcccaagatctgaggcgctttacaatcttgacgtttcataatcagaccagctgtgacatttcctttgatgggaggggtaaccgaggcccaggagatgatgaggctccctccatggagctccccagtccccgtccaaggcccaggcagtgtgggactccctcaggttcctcataccacacccaagacacggggtgctgcttgggcactgtggcaaaagctggctgcccagagtggtggtggcacaggagggctgcggggttgaccttgtggctggtaatctgcctttgtccaacccagacagggtgagggaggcccacacctccccctcgggggctcaccgaaggcagtggggccaggtgccagccaggctccaaagcctggtgccccatggcaagggccagccccctggccctcttggtccagctgccccaacgcctgcagcctgttctggctcctggcctggtgcggggcaggagtctggtgcagctgtgaacatcccccgccttgcagccttcctgcccttccttgatggaaaccgaggcacaacatgtgtgggctttccctccctgcccacccacctgtgtatcccattcctctggaaggccccagtcctgcctcatccgcacccacctgggcagcaggtgggaggaggaagtggacttggcacccacaggctgcgggggcgggcactggtataactggtttgggcccagcctccagagcccagggctgagaggccaggctggcctgaggagggacccgggacctgagtcactgcacacacgctgggtggggggtggctctgtgactcatgttctgagcccagcccctcacagactggggagggatggggaggggccatagagtcctatcctgagccagacagcagggagccctgcagggtttgccttccccaggtggacaggcagccaccagggccatgccggtgccatgggggtgccagggccctgtgggcaggacacccctgcccagccaagaaaaaacaaggagccaggggcactggagctcagagagggaggaggggatgggaggggaggtgagcagtgtcccatacgacccagggcaccccaagcgctgagcggaggctgaggagtgcaggggtgtttgtaacagggcacctgctgtacagggaagaggctctcgggggcagatagatgcagggcaggggctggcaggcagctgagggagcagcaggatatgggcgacccaggcccgccgcccccccagccaggtgactcagctactgccttagttcgtgtacctcgcagtgcccaggacactccggttctttctgttcttcccacagtgggcaggcagcaggccccgctgagatggttctggccccgctgtccctcaggacagccctgttgagcagcaggctggacaggcctcctgctgggcccgtgagtcactccagtctcagagcccatttggggcaggagggagcttgtggtttggttggagggctatgtgtttggggaatggggggaccaggtacgaggagacacgaggactgggaagggtcaggccagaggggcctttaggaccttctggggcacgctggaagccagacggcagctgcgttaggagtggcatggcaagatgttcattttcaaacatggttctaactgcagcatcctggagcacggatgacttctctcagccctgggctggacatccagggacgctctggacagccccctgccccatcgtcttgtgagctaggtgtcccacaaagccaggtcccagctgacctagcctcagccccacctgtgggttcgctcctggcagcaggatgacctgggcacatgctgtcaccttgtgcgtcccctttcagagcctcagagtaaggtgaggcttgatgagggcttgtcaccgtagaacacacagaagcccagacttcagcagaggttcctggagacgcgattgaaagccaactccacgccctgctatctgggcagcctcaggtgtgggctgcggttggtgggcaggatgcaggtgggctgcgccctgcaggtccagaggggccccagaacagtggagttaggggcagccggcagctgtgaacccagccctcatttgcatataaggaaatgaggtcacctagcaggtaagcggcagagaagggacagaggctgtgggtcccctgagtcctgtccagtgtcctttcaacagcatccagacagacactcctgtaatccattcaactgaaagagcaggaggagacaaagacaaattaacctgtccccaccttcctggtcgtggctccactgataaaagtgttggatgagccccgggaagccagcgtgcccctgcgtctggcaggtcgtggtgaggttgaggggggctgagcaggaggggctgacggcaccgtgctaagggtgcttccagtcaatggtcccgggggatgcccaggctgtccggcgtgcagaggccccagggctggggccagcgtgctggatttccttcccactcccgtttccctcctggcagttcatttttggggagcaggagagctgtgactggggaaggacagcctgcgtctcccccagcagccacccacggcccctggcacagtggtgggacctgactccctacctcctggggccctccagggtcccccagccccaggctttcctgttgcccacagcagcacaggcctttggtttacccaccaccgctcgagggcctggcttcctgccaccatgccttgcttgtcaccagcctcctaaaatagccatcgaagtggtgcgtctgctcctgtgtacttctgggacatctggcaaataaggcaggttttgcccctgcccagccagaccctgagctgtgacacgcaggcctctgaggccagggtcccaaagaaagggcccgtctctctggggctggccacaggggccagttgtccctcctgcgccatacatctgtgcctgctggctggagggacaagctgtggcgcccgagcccagccgttccccttccctggcattttcccaaaggaagggcccattcgtgcggaaccccagcagccagaaaacctgagtagctgacgtcctgggcggtgggtgctgcaggagtcggagctgccctgatggattggcgggggcagcagcacaggtggggtggatatgccagcacccccctagactgatgtgagcttaggggtcccacctcagaaatgaggggtggccaatgcccagactctctggactcagaggtggccccactgactgtcctagtcagtgtggctccaagtcccctccttgctctggcaaacggatgcaggtaagtgtgtgtacaagtttgcccgtgtgtgtgtgtgtgtgcgcatgtggctgcggtgaagaggggcgaggaaagtcctttctttgaactccttggtggggacatggtggcctgtggctggccttgtttttgggtgcaagggcatcttccaggaccctgacccctactgggtgcctgtgccctgaggccctggccagggcagatttggaggatctgttgaggttggggcagaacttgtgctgcgtgtgtgaatggctcacacatttgtccgatcatctaatgatcactgcggtctccgcgcagggtccaaccctggaccacctgccctcaggggccagattctagccagctggtaaagcgagtccttctcagatggcatgctgtctgggaaggagggctggggcctcaccaagaagggcccttgcaggctgtataggagtttgctcagctgctgagaggaaggccgtggcggtccggcacaggcctggaggccttacagacgagctcagtaggaagccccaacttcctcctgtctctccctgaggggagggggctggctgagcccccaggaggcaatggtgacagttggaacagccagcttcaggtgcctccgtccccaggagacaagacctgccgattccttccaggggaatcacaggccaagtttccaggtggggactcatggcagggaagctgacggtacagccagagtcccaggccttggtagtggcccaggaaggtgggaaggtggcaaagcagcctgaggggcacctccggggctttgcaaggctctgggatcccagcccaaagccccctccaagcccagcatgccccacactctagaaagtggggaggggccaacaggaggggggtcggtttctgagggcctgctgaatgccaggcccacccttgcccacgctggggaggcagcatagccatccccatgacacagcacaggtgcccaggtctcggagagcccctcccagggacatgcacaccaggcttgccctttggagcctctcctgaccttggccagcgtgggagctgctgttcctgggaggatccgccacctgccccaggcgctcaccagcctggcttccacagctgctacccacaggggctgccggggcctgcatggcgtggcgagggtcagggatggtgagcgccccacccattccttcatccatcacctaataaatgtgctctgagggtcccagtccccactctttaggccacagactgtggggatgtgggaggtcagatttaagctattttagtgcaaccaaaggtgcaggttgggggatgtggctggggcgcctgggccctgggacccgcaccctgtgcagccgaggctgttgcccgcaggattcagtgcccggccatcctggctgccctggccaccctcctgggagctgtcctcagcttcacctgcatccccgccagcaccaaaggggccaaaactgacgcccaggctccactgccaggtaagccccgccaggtacaccctgcccagatgctggggcaatggaaggcattggctaggcctgcgtgctccagccaaggggtacggggggcctgaggggaaatctgggggctactcacaccctcctgccttccttgaacccttcccagctgctgacatcatagaagccaagtgaggtgtggtcatgaagaggtggaagtggggctccggcaggcagggaggcccagagaggcaggaaggcccagacagggaaggcgttaggaggggaggcccagacagggaaggtgctaggaggggaggcccagagaggcctggggaggaccaggagggacccccccaatggggtgggtgggccagcaaggctccggaagctctgagtgtccagggagaggcgagggtgctgcccgaggggcactcattggtggagggcagaggatggtcaggctggtcccatgaggagaggccaaggctcctcagagggggtcccctcaaggctggccccctgctgaacgcagcccctttgtgccaggcacgtggcagggcccatgcctcggtgcctagggactaagagcccagcctgggccagagggacccacctgggaccatcctggggcaggaggctgtcatggaattaacctagaaagtccagggggagggccgggtggagatgggcctgtggcgagcacagcagagccagagaggcaggagcccctgagacaataaggaggaaggactcggtgagccgggctgggggcctgtggcttcgcactcagaggtgcccggtgggccaggccacggcggtgacttgtggccacagagagtggtacagtattgccattgtcttcctctgggctggtggcctggtcatgctctgccccaggccccaggccaggaccatataggaagcagctattggtcccttgttcagggactgccgcaggcctccgccactgcatgcccaggttgaggccagtctacctgcgtgcagagaatgcttttcctaagtgcctctggggattcagggggcccctaggaatgcgtagaagtgtgctgaggggcggtgcccaacctggcagctgggagcatcaccagctcccattcccacaagtgagcggtgctgaagccaaggaaggaagctttaccctggcgggcgcaacagggccctccgaatggcgaggcctgcagccgggcgaggggtgggcattgggacaatggcctttgcaggcctgaatggcctctccgtgccaggcggcccccgggccagtgtgttcgacctgaaggccatcgcctccctgctgcggctgccagacgtcccgaggatcttcctggtgaaggtggcctccaactgccccacaggtgagtcccaactactgccccaacagcggccagagcctggcagagtcccagctgcggccagggcccggcccttcctctggcctgtgccccacaggtccacacagatgtggtagagcaggcaggagcgggaggaaggcagaaaagtgtctttcccacctccttccagcccctctacactgcacacctgcagatcccagggtgggcccccacgggcagagggcctggctcgcagccatgcatccctgtgtgctcctcagctcttaccctcataccctgtggccccacgtcctctccagacagcctgagatgcagggacagcaggtctgagtgtcaccactgccttctgcagcatgctggccctgggccctctcagcagaccgtagggcgtcacggaccacagataggatagcgagccacggacaagcccacgagcagccctgtccctcagaagccccgcctggactcctctaactgagaagccaggaagcaggatggagaataggccctcagcactccaactggcaccggcccctgtcccacccagcccacctaggccagctctgttggttctcaaaactggaacccaagttactaacctcagtaacaggccctttgagggcccttttttttttgagaccactgaccaggctggagtgcagtggtatgatctcagctcactgtaggccccacctcccaggctcaagcaatcctcctgtctcagcctcccgagcagctgggactacaggcatgggccaccacgctcagctaatttaagtgtttgtagagacagggtctcactatcttttccaggctggtctcaaactcctggcctcaatcagtcctccctcttcggcctcccaaagtgctgggattgcagacgtgactttgagggctcttataacagagagccgtggtgggtcttgggggccaaatcctcccacgtggtcagccctgggtccctcccttccagcaccttcctgctcacagtccagagcttagcaaccacacgagaggcactttccacaccagggatacggcagaatcccagggaagggtctcattggcccggctggcatcacaggcccctccctgaaccagtcaccagccagggcccagacaccctgattggccaggctgctgaggcgggagggaggtgggcgccaaggtcggggtgtgggggtactcacccctgttcccctgccccggctcagggctcttcatggtcatgttctccatcatctccatggacttcttccagctggaggccgcccaagctggctacctcatgtccttcttcgggctcctccagatggtgagtgggcacacagggcctgctggggggcacggcaggggtctccagtggggcaggcctctgagagtagaggctcctccccggcggaggctggggagcccttggcctcccatctggcacatgtcagggtccacagggaaccaggcatacaggccagggagggagagccaactgcagtggtgggcacgctgtgaggacagtggactccggcctctgatgggcagctggctgggatctgtggcagcccacctgcccaccagctgtgtgaccagagcaagtctcccaaactctccaaatctgtcccatgaggccaaagtgcccgccttgcagggtccttggcagatgagatgacctaacgtggcaaagtggttagaccagcgtgggcccctttggaggtcccataggagcaagacgccagccctcagaggccacgctgtcatggtaggataagacgccagccctcagaggccacactgtcatggaaggatgccctgaaaccctggcagctccgatgcggcaggtgtctgtctgccagccccccagaaccgctcagctcccgggccggggcgagacacctccaccaccagctcctctgggcttctggaccagaccctgggtggtggggacaggtgatgatttgccaccacccaggatggctgcctgacagccagagtgcggggcgggggggctattctgggacccgccagggtgggggtgggggctctcggcctctccggaagcctgtggcattcctggcacctccaagccatctgctcttcagcctctgggcccaggactagactagtgctaaaatagctgctcctgggaggggctggacccccaccgtgggcagagagggcctctgctttttggggcaggaggggccaccctggcagggtaaaaagagataaacagaaaaacaacagcaacaataatagtaacaatccggggttgttgccatggggcctgttctgaacaggctgcgcccagctcactgcgaggaaggacgcttagccaggccctggctgaagcctgcagctgggctggacacagcagtcattggcctgtgttgtgggggacttgggcctgccatggctgcagtggggaccctgcctgagacagacagagctggggtggtgaccaacaccgtcggggcaccctcgcaggaactgggcctggtgaactgcccagggacggggaaggagcagggtgaggcatggggaccccgacacaggttgagcagcgggagaggaggctgaggaggggaaggagggggcccgcagagtagcccccagaccccaagtccggtcagggacaagcttgttagctccaggttcatgtcacaacctgcagggctcctaagttcaagcttttttaaacttaatgggcaaactgagacgcaacacaaataggcttctgaccttggtgtctgagtcctggatctgaagtccttcacggcactcactgtgagcccctcttagacgcactgcacgaagtgagcttgccagctcttcctttaagaaacgtgttaggccgggcgcggtggctcacgcctgtaatcccagcactttgggagaccgaggcgggcggatcccaaggtcaggagattgagaccatcctggcgaacatggtgaaaccccgtctctaccaaaaatacaaaaaaaaaaaaaaaaattagccgggcctggtggcaggcacctgtagtcccagctactcgggaggctgacgcaggagaatggcgtgaacccgggaggcggagcttgcagtgagccgagatcgcgccactgcagtccacgctgggcgacagagcgagacgccatctcaaaaaaaaaaaaaaaaaaggtgttaaaatcccaaaaaaccctaagataaagcaagtgtgaaagtaagatttttaaaccatttatggttccggttggaagcagtttctgttctgcctggcaggaatttgggagggtgactggtcccctgcagaggtgctgcaggctgggcctgccctgtgggcagatactgagcccaggggctcctccagccggggccacccctgcactcccaggcgcgttggcccagcacgccctgcttagtggaggagctgagatgaccagatagagagcctcgccctggcctgggagcagcctgcggccaagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccggtgtccctggtgtgggcctttccttcctcccttgtggagaggagccccgactcctcagggatctcagacccatcctgacgcagtcactgctggcggagtagggagagaccccggggcttgcagatgctgaggggccttctctgcagaggggccctggccaccacaggccagtctggaggtccccagctttgggggctggccacagtccagacgcccctccctcgcctcccccatacccacttctaccctctctgtctggctctaggtgacccagggcctggtcatcgggcagctgagcagccacttctcggaggaggtgctgctccgggccagcgtgctggtcttcatcgtggtgggcctggccatggtgagggctccccgctttgggcccactcacctgaccctctcactgggcaaggccacctgggcggtaccatctgtgcttaagcccttggggactcctccagccccccacacccacccggggccagctcttcagcagggacagcagtcagggtggggagggacaggtaagaccccagagaggagcctggtcccgtgaggcccccactcagctcggcccccgcctgccgtcccaggcctggatgtccagcgtcttccacttctgcctcctggtgcccggcctggtgttcagcctctgcaccctcaacgtggtcaccgacagcatgctgatcaaggctgtctccacctcggacacaggtgagtgtggccagcgagtggagcagcctcctccaggaagccctaggagctacccggtggggatggggtgggcagcctagggtctgtgtggggtgggtagggtggggggcctggggtctgtgtgggttgagtggagtgggtggggtgggggcttggggtctgtgtgggatgagtaaggtggggagcctgggtcttgcatgagactcctgccctaccacctagcccagctgggggcaggccaggggcctgggagggggctgcccgcaggtggcagttggcttggccctgagaagcacctgaggactttgcctgccaggcctggaggccccggggacttctgggccctcccccagcacggggagtggggcacacaagtgctcaggagcttcctgaatgaatgagggagtgaatgaatgcataccagtaattaaatccaggaatcccctaggccactgcaggggacacaggtcccctagacatagattcccccagtccccacttccgacccagctttctttcttgaggccgaagagagccgctcatgcagactgggggtgtcctgggcccgatgttatccaggctcctgccccaccccaggcacagtgtgggtacacactggccagtgcagggggctcctgtgggctggttgaggtcaaaggactcaggagtcctttggagtactggagattcttccaggcctccccagcagcagatccagaaagctcagggcacacatctgacactccatccacctgcctgtctgggaggcagcagatccagaaactcagggcacacatctgacactccatccacctgcctgtctgggaggcagcagatccagaaactcagggcacacatctgacactccatccacctgcctgtctgggaggcagcagatccagaaactcagggcacacatctgacactccatccacctgcctgtctgggaggcagcagaccaaggtctagaggcccggatgtggccgggctgcaaagggcaggcctattctcagggctgcctgggaacctccaaggccttcggggactgtgactccatggtgcatgggctgatgcaggctgagccaggagggcttcctggaggaggttgggcagcactttggagaggccaggaggatggcacaggagaggaaggcctggggagatgaggacccggcctggctgggaagaggcccctggaggctgagggagaccaggcccaggccattgggccacgtcatgcgcagacaccacccctggcctggtaggagccagcatctggttcccagcagcagcttggaaacccagcgacagaaggggcaggaactgcaccctgagtctgcagaagaggctgctcttaatggtcctccatgctgggccctgagcccaggtggggcctggccagctcctcatcacagctgaccagccctgggagttccaactccaggagacctgggctctgaagtccctggagccagagaccctctgggcacgggaccagaggcagtgtcctcccacctggagtcctggggggtcctcccgcttggcgagtgctgccccccttgttgcccgagtgttgacaacagccacagatagtgcccacgtgcccgtccatgctgcgggtagctggccacaggggcgtggagatgcggtgtcagggacagagcaggctgctgcgcaggtcggggctgtctggggagcctcggaagccgctcggtcttgctctggggacaggaggggcaggtggaggggccctgcatgggcttccaaagcccctcccagccctgtgagggggagttccatggagtagtaggagctccgcagggtggggcggctggaggaagggctgatggccaggaggggccgtgggatgggggtgtcatgcccactctgaactcaagccccaacggtgtctcacaggccaggcttagcctccccactgcatcaccagccctcggtggtggcaggcaccctgggaaagagccgtgagagccagctccctgacagcctgggcgggaggttccgggccccaggcacagatgccatctcccttggcaggcctggcagggcggggccttctgcggtgacctgtggtcccattcccaggctcctcctgtgcttggaaactttctggagcagggaagagactcagcccaatgccctgggaagcaccctgcatggctgagaggtcctcggggaacagaccagtgggtagagagagctgtgtttgctccaaaggctgggcgggtggcagggggtgggggactggaggttagaagctggcaggtggaaaggatgggtgttcaggggagtatttcaccagactatgcaaggtgcggactgcgccgtgaggtcagggtgggtcaggagagatgggaggccatggctgtgttcaggaagtgggcagttggcccagggagctgcccagggcctgactacccccatgcaccccccagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctccgacctcttccggcctggtttctgcaggctcacgcatggtctgcctgcgtccttcagtgagggatggggcctcgggctggagggcttcctcaaggagggcgcctacagctgggcaaagctctggggaggacagaaccacccaaattggttcactgttattagtacagccctgagtccgcccatggaggaggtccccctgctgccacacaaacagctcttgctcacatcccaagcaatggcgagctcactgcccaactcccgcccacagtgtgcctgcccaagagcagaaacaggttgctttaaaagatcagggaacctggctgggcgcagtggctcacgcctgtaatcccagtactttgggaggccgaggcgggaggatcatgaggtcaagagatcgagaccatcctggccaacatggtgaaaccccggctcttctaaaaatattttttaaaaaattagctgggtgaggtggtgcacgcctatagtcccagctactcgggaggctgaggcaggagaatcgcttgaacccgggaggcggaggttgcagtgagccaagatcccatcattgcattccagcctggcaacagagcgagactccatctcaaaaaaaaaaaaaagatcagggaactgaggccttcctagatggaaggaaaaatgccctcattctgctgaacagtccagcacacagacccaaaccctggtcgcagaactgtaccaaggaggctgccagccacccgaaccccagaaccgcaccagacactgccagccacccgaaccccagaaccgcaccagacactgccagccacccgaaccccagaaccgcaccagacactgccagccacccgaaccccagaaccgcaccagacagtgccagccacccgaaccccagaaccgcaccagacactgccagccacccgaaccccagaaccgcaccagacagtgccagccacccgaaccccagaaccgcaccagacactgccagccacccgaaccccagaaccgcaccagacactgccagccacccgaaccccagaaccgcaccagacactgccagccacccgaaccccagaaccgtaccagacactgccagccacccgaaccccagaaccgtaccagacactgccagccacccgaaccccagaaccgtaccagacactgccagccacccgaatcccagaactgcaccagacactgccagccacccgaaccccagaaccgcaccagacactgccagccacatgaaccccagaactcctctggtgtccccttatctcagcctcttcatcctacagctcagtggcccccaacattttccgcaccagggaccagttttatggaaggcaatttttccacggatgtgggtgggccagatgaaactgtttcaccccagatcatctggtattagattctcatggggagtgctcaaccttgatccctcttgtgcacagttcacaacaaggttctcgtccctgtgagaatctactgctgccgctgatctggcgagaggtggaattcaggcggtcatgcttgccccgctgctcacctcctgctgtgcggcccagctactaacaggctatggaccagtacccatccatggcctgggaactgggggtcccttctatagctgatttgctggccaggccatgtaccgttgccttcccagcctcctgaccacagcacttcccgacccctcacccccaccccctggtcctgggctctggggaggagaactgggcatgaggaggccagcccagccgctgtgaccgattgacccatctggagaggacaggctttccacagcctcagcgagggtctgcagctgcccctgagaccatgaaggccgcccctcctctcctcgggctgcttttaaaagaagctgttgaaacatggactccccaaaccttagaattccactgtcctcagaatttgaggaattccaaaattcctcaaacaagaagtggcctcagtgagccaagggccatccaccctcttcgcctaaagctcaggccggatcatgcctatgcttgaagcacccaggggcaagggctctcctcttgaccttggatatccatccaggtgaggctctggtgggccagccaggaggcccaggagcccagccaggcagcgtccttggctgctgttttctgctttttgcaggagcccctccccgatctgcacaggggcttcacaaattgcgttcgggagaaacttccttgcaggcaatagtttcttctggacctagcaccaagactcctgcgggccatgcagcgaagggatagcaccctccccgccctgagcccagaccagctaccaggcttcgtcggcctcctagcaacagagattagggtccaattctggtacttctctgcctcccctactggcatccctccaaccacgaaggttccagaaatgaaggccccattgtggggtgaggagtcatgcctgtaccccttatcacctcctcagcttgttcatcaccaggagcccttctgggtgggggacacacttcctgaaccctaactgtctcagaccatccctgtctttcaaagagcacagccagaccggagggcagaaagccgtggtcagctatctcagaaagaggggcagggatttgctgcactcaggcctctccaccccaatgtcctgggccagtacctggaggtgcagggacctctgcctcctgccccaccatcggagacagcccagaactctctcctgttcccccagaagcaaaggcgaccctgcccgccccacactgcgggcactggcaaggagcggctggcggcgggcagccagagggctgagggattccttctggtctgactgcgcgggtggtttgtgggcaggaagtgctgctggggaaggttcccccaccacaggcagcagcagctcggacccagggcccttgtcctccccaggttcaattcctcaggacacaccaaggagcagaaggtagccagggtcaagccccagggcacttcctggcctctggggaggctgcttggaaaagagggtgtggaccaggcccagcagatgacacgattcatttattcattcaaagccggttcccagcgcctttcacaccagccccgcaggactggatgagggtgtcctgcccgcccattcctgggcctccaccctcccagcaggagtctcactgagccacagccggatggtagaaaagcaaactggccaagtgatttatttgcaatgggcacagtgatgcaaaaacaagatattaagactataaaatatgtgactacaaagaaccagcgaaataaatacatagatattagatagtccaataacttaaggcgcccgtgcaacggagcgaggatccgcgcgcacgggaagttcttctgctgcagggctggagagcgccggccacgtcctagcctcggtccgactcgtccagcgtatggccctgtggggaaaggactgggtcagagagctgtgccagggccggtccgggtccagcctgaggggccccgagaccctgacgcgagggggccagcgcgattgcggggcgccgggtcccccaaggaggtgcagcgcccccgccccgccgtctggggttgaagtggtttttcccaaaggccccggtcccggctgttagggcgcagggctcgccgggacgcgggcagtcactcaccgcggcgggctcatggcgtgcggggtttgggctgcggggatggcctggagggctccgagggctcggagggtgcggcggccgcggcagccacggcgtcctcggcgggtgcggcgggtgcggtgcgttcctggcggctgcgaaagtcctgcagggcgcggcggttctggaaatcgatgagcgccagcgcgatggccgcgttccagcagctctcgcccgcgcagcggaagtcgatctccttgtggtcggtggtgacgatggtgaagtacacgtacttgcccgtgcgctccacgcagtccaccttgaggatggagtggaagcgcagctccttggggcgcgcgcgggggctggcggggaacaggctcaggcggtcggaggtgagcaccccgcgcttcttcttccatagctggaagaggctgtcgctgcgcttctccaactcgccctcgcgtagcacctcgtcgggggatttcatgtcgtgccgagcgcgggactgggagcggcaatgcgggcggtgacggcgccggctctgctcctcgtggccccggcgcggcctttatagctgcccctccccgccccgcccctccccgccccgccccggccctcgggccaccccgcccgcctgagccccgcgcgccccgggccataccctccccaagcccagccgtccgggcccgcaccgtcgcgtccgcgctctggtcggtccccggccgtcccctcccatctcagaagcccgcgctcctcttgccccccgtgccccagctgtccggccccgtggggtgactcgaggtcccgccccgcccgggcgctcgcccgcaccgtctcgcaggccggccccgcggaagaatgcgctgcagccagccctgcccgcgatgactcacgccggggagccccgggaagcacccgcgggcccggggccggcccaccgtggggagacagccgggaccagaccttcaccctccaggcgccccaagtccagccctgccgctctcgggctcccggggcagaaggagggtcgaggcccccttccttactcccgagccctggccgttccgtcctgttcgggggcctttcccagggccgcccagagaccctctccgaaagtggccctgccctagcggaccgagctcctatcttgccacccacgggctgcgccaagaacgaccacctctcttagcctcggttttcgcttctgtgaaatgggaacagtaacctttgctggattagggaacacgtggaaagggctagaccagcaacccatagagctcagaaaatggaaggggaagaggaagcccgttctcctccctgcgccctcgtagtgtcccgaactggggtacggactgctccgaccgcgcccccacgacccggaccggagagaggtcccaggagctgaggggttcgggctgggccgcgacgcccgctctctgggatcagcctgggggcgagggtcggcgggggcggctgagtcatcgctttccagctgggcagacgggcggttttatttaccctcttcctttaaagggtttaatagacaggaagcgaaagccggctcttcccgggttcccaggggtgggggtggagccggccgagaggaccccagagaccccggctactactccacgtctcccaccttcccgcacccctgccccctagctgcgccctggggtggttacagcaggaagtcccaactctggggtcagaattggcctcaatgacggggctcacgcaaaatgaaaacgagagtcccctgattcaaaatgtatttaaaatgtcaagacagtggcagcagagcgtaaaacccagacctgggaccagccctacctccacctgcccttcagggtcactgtaaaggataaagagacgtccggctcagaggagcgccccagacccggttctgtgaatggcatgcaggtagcagctgcccggtggtcccaccggtgtggccagaggacctggcagtgggcagggatgtggtgtggaggggcagtgccggcagagggcagggttgggctgtgccagggttctggcctgggagtgagacacctgcctggggccggcgggtcaacactgccccctacctgacacctgtccttgcagcagggctgggatcctgtggtgagggagcagcaggtagggtgggtgggtgaggggaggtcagcctttggcggggagaggggattcgagcattgttccggagaggctgcaggaaggattcggactctggtgtcccttcttttgcttccagagggccctgggctgccggacagtgggacctgggcaagaggcacctctgggcagtgggagaccaggagaagcggccgggggcagagcgctctgtcactgcgccagcccacaggtgcctggaacacctccaggcccaccagcctgcctaccccattgaggggccagccagtggaacttcggctccaggcaaatcccccgacactcgtggttgcttaagcacctactgtgtgcctgcaggcctggctggtgctgggaccccagaggaggggagaggaatccctctaaaccccaggggcacagcaggtacatgaggatggggataggggtcgggggtactggaggccaggaggacagcttggaggactctgtggggagggcgtgccctcgaagattccaaggagaccttgaagggccagtggtgcccgtatgccaccactgtgcccagcctccacctaacccagagaactccccaaagtgggcactccagcccctgttccacagaagaggaaactggttcaggatggagagggccttggggaagggacagagaacaggcaggagcagataaggggctgagagaaatgagggggaggaagagggtttggaaaccaggtgaggccaggtgaggtgtgctcccccagccccgcccagctcctctctttgcctgtaccccagtggccctctcaagggaggctgggaaactcactcccctgggggcaggacttacaacccaggggtgatgctctgacaggtggggcaggagctgggaggccagggggcagggtgtgcagccgagattcagaggccctgccctccctaggggatttcctgcccactcagcccctctctgctattcccctcatggacactgtgaagacctggggggtatgggggtggatggccctttaggggctgctggaaatcaggtctgagccctggaggccaggcctccccaggcagcttctctgcccacagtccctgccccaggggctcagttgtagtggccctggcctccccagcagctgctagacaccctgggcccctgctcggccaaaccagcctgaacctggttgccaatgtgggggctggagggagccgactcccaagccttaccagccctggaccagcaggtgacttcaggagcccccagggtgtctttatggacatgggcaaaaataaaccacggccttaggaggtgagaggggcttggaggacaccatgccaacttggcaggtacttgcacacaggggctgccccatcctctctgcgtccaccatccacccgaggggctttaccaccaccactaactcacactgccgtctgcccctctgagccacccgccctctgccagcccccgctcggcctcccttgcctgaggcctgagcctcaccgcctcacctggtcccacctggggctgagcggtgcccccaggagaagcactggccccaagctgcagatgcagaaagggtggctcagagaggtgcagtgacttgtcaaggtcacctttccaaggagggaccctatctctatcccccagagcaggcctgcctgagggtcccctctggaggatgagggctgtgacactcacttcctgggatgtgggggagggatgttgaggcagaagagtgctgacacagggaccccacatgagggtcttttgaggaatgcccctcctagagccatttgatagccaagagcctgggagcttctccagcacagcacagagattggaacccggcgtggattcggccacaccccatgggacctgcttctacgagggttctggaccactcacgtgctggaggcggaggaaccacctgccggagagatgccagggccaggcaccggcaggagagtccgtgtggccctgccccgtgctagttctgtgcggtcatttctccctgttgagactgctttcttgggtttgcagggaacactgggtgggggtttcagagaggtggtgactcacccaggttacacagtggccagtgcggccacatccacagcttccccgattctgtggcaccctgtggctcggggcaggaaacagccctgatgttctgtgactgcttctcaggatggggagggggctctgcctcgagttggtggtgtcaggcagcatcagtccaaaccgggtttactgatatttatctgaggggccacatccaggattcatgcagagcctgagccaagggcccccacccctgggcaggcattgtacagtctgggtgcccaaacatctggcctgggacactggctgccctgtccagctgcctggacccttggcaccggagcccagctgtgtgaggctgtcagcagctggagtaggatgcgggcacctctccgaaactccctgagtgaggtcacttccttacggtgacgaggccgggccctccaggcacttgcccaacgagcctggccatcctgccagcctgtgaggaagctgcgtgtcacagggcccggcccagtgcctggggcttgacaccaccctcttgtgggaggggttgctcagagagagccctgcagaaaggcccactgctcctcagtcaggaaggcccacccctagctcctctcaccccctccaggaagccctctcagattgccagggcgcactctaaggcctgcctcctgccaaccacatactgctaggccatgggtctccaagcctccgcccacctgagcctggggaggctgggggaagacctaagctgcctggagctgcagcacctgagcagtgcactggtgccacctcacctgagcccaacatggcccatgtgccagggcctgtgactcaggcttgccctctatctgtctcctcccagctgcagcctgaggaaagtgagaggccccgtggcatgacccacctggttttcagacacttgctgtcagcctgatcttggccttggagggctgtgttctctgttgctgtgtctcttcctgagctcttccactggagcctgacaggcaggtcctacctcacaagatgttggggattgattgagaaaccaggaacacccttctccttggcccctgatgagctcctgtttatccctcagtaccctgctcagaagctattatcagctccttaaatgcagtgataatgttttattctttgggagccccagggatcagcccaggcactcaggaaatggctaaaaaagcatcctgaggccgggctcggtggctgacgcctatgatcccagcaagttgggaggccgaggtgagcagattgcttgagcccagaagtttgagaccagcctggacaacacagcaagacccccccatctctacaaaaaaaaaaataaaaattagccaggcatggtggcatgtgcactatagtcccaactacttgggaggctgagttgggaggatcacttcagcccaggcggtcgaggctgcagtgagccgtgattactccactgcactgcagcctgggtgacagagcaagaccctgtctcaaaaaataaaggcatccacgtcattgtccaaaagaccccctctgcactgactactgaacgtgcagactgttggcgtgtgtatgagaccagacagccccttgctgcctcgggtgagactggcagtcaggcgtgccaagatgagggggccccgtggggcagagtggggcctccgtcgggctccatcaggctggtgtcacctccacagggctgcttgtgggtggttatggagcctccagaggttgggagatggggccaggacacagggagctcaggaaagggccctcccagcagtcactcgcagatggaaaacaagagcagccaacatgaccgccctgcacctggcttgtggggatgtctccagaagcttgaaggagtgaaccaatgaacaaaggaacaaacaaaatacaggaagggagagagggaggactgaggtggccccatgccctgcacagggctcagattgcagaatcgctggggcagccttctcacagcgcagatgctcaccctcctggcctgaacttctcattccgccggtctgggggagccctggcaggtgtattgtcattaattatttccaacgttaaaaaattaccaaagataggccaggtgctgtgacttgtgccagtaatccagggctgctttgggaggaccaagtgggaggattacttgaaaacaggagttcaagaccagcctgggcaagacagcaagactccatctcttaaaaaaaaaaaaaaaaagtccaggcgcggtggctcacgcttgtaatcccagcactttgggaggccgaggcgggtggatcacaaggtcaggagatcaacaccgcagtgaaaccccgtctctactaaaaatacaaaaaattagccgggtgtggtggccagcacctgtagtcccagctactcgggaggctgagacaggagaatggcgtgaacccgggaggcagagcttgcagtgaaccgagatcgtgccactgcactccagcctgggtgacagagcgagactccatctcaaaaaaaaaaaaacacgcctaccaaaaatattaaccaattgttgatataaaaagtaaaaaagaggctcgaattatttcagaattgatgctgggcacagtggctcgcgcctgtaatcccagcactttgggaggccaaggcaggcagatcacttgcagtcaggagttggagaccagcctggccaacatggtgaaaccccgtctttactaaaaatgcaaaaaaaaaaaaaaaaaaaaaaaaattagccgggcatggtggtgcacacctgtaatcccagctactcagcaggctgaggcaggagaattgcttgaacctgggaggtggaggttgcagtgacctgagattgcaccattgcactccagcctgggcaacagagcaagaaaaaatgaaaaaaaaaaaaaaataataaaaacaaaattgagtgttcatctctcatgtccccacctagggccactctcatccttttttgtttgtttgtttgagatggggtcttgctctgttgcccagactgagtgcagtggcgtgatcttggctcactgcaacctccgcctcccaggctcaagcaatcctctcgcctcagcctcctgagtagctgggaccacaggtgtgtacctccatacccagctaattttttgtatttttgtagagacagggtttcaccgtgttgcccatgctggtcctgaactcctgagctcaagcaatccacccatgtcagcctcccaaagtgctgagattacagacatgagccactgagcctggcctctttttgttttattattattataaatttttgagacagggtcttgctctgtcacccagactggagtgcagtggtgcaataatggctcactgcagccttgacctcctgaggttgtgatcctcccacctcagccttctgagtagctgggactacaaggcacatgccaccatgcctggctactttgtatattttttgtagagatggggtctcactgtgtttcccaagctggtcttgaactcctgggctcaggcaatccgcctgcctcatcctcccaaagtattggaattacaggtgtgagccactgtgcctggcctcatcctttttaaaaaagcatttacatttcctttaacaattgatttttgtttgtttgtttttgagacggagtcccactctgtcatccaggctagagtgcagtggcacgttcttggctctctgcaacctccgcctcctgggttcaagtgattctcctgcctcagccccctgagtagctgggactacaggcatgtggcaccacgcccggctaatttttttgtatttttagtaaagatggggtttcaccatgttgtccaggctggtcttgaactcctgccctcaggtgatccacttgccttggcctcccaaagtggtgggattacaggagtgagccacagcacccaacctcctttaataattaaatataggattgccctgtgatccaacaattccacttctcattcacatgctcacaagaactaaaagttagagtctctcctagagatccatgcacacccatattcccagcagcatgccaaaaggtagaagccaccaagtatccactgacaatgggcacacacgatgtggtccacacacacactgaatagtcactgccttaaaatggaagggaaatctggtcgggcacgtggctcacacctgtaatcccagcactttgggaggccaaggcaggtggatcacctgaaaaattggccaggcgtggtgatgcctgcctgtaatcccagctacttggaaggctgaggcaggagaatcgcttgaacccaggaggcggaggttgcggtgagccaagattgcaccattgcacaccagcctgggcaacaagagtgaaactccatctcaaaaaaaaaaaaaaaaaaaaggaagggaattctaacacaagctacagcacggatggactctgaggacactatgctgagtgaaataagccagacacaaaaagacaagtactgaatgattccacatgtaccaggtcccaagagtcgtcagattcagagacagaaggtaggagggcaggtgccaggagctggagaggacaatggggagtttaatagggacacagtttccatttggggagatgagaaatcatggaggcagatgctgatggcggctgcatgacagtgtgaatatgcttagtgtgaatatactcagtgtgaatacgctcagtgtgaatatgctgagtatgctcggtgtgaatatgctcagtgtgaatatgctcagtgtgaatatgctcggtgtgaatacgctcggtgtgaatacgctcggtgtgaatatgctgtgtgaaaatgctcggtgtgaatacgcttggtgtgaatacgcttgtaatatgctcggtgtgaatatgctttgtgtgaatatgctttgtgtgaaaatgcttagtgtgaatacgctcagtgtgaatacgctcggtgtgaatatgctcggtgtgaatatgctcggtgtggtgtgaatatgcttgtaatatgctcggtgtgaatatgctttgtgtgaatatgctttgtgtgaaaatgcttagtgtgaatacgcttagtgtgaatacgctcggtgtgaatatgctcggtgtgaatatgctcggtgtgaatacgcttagtgtgaatacgctcggtgtgaatatgctcggtgtgaatatgctcggtgtggtgtgaatatgcttgtaatatgctcggtgtgaatatgctcagtgtgaaaatgcttagtgtgaatacgcttagtgtgaatatgcttggtgtgaatatgctcggtgtgaatatgcttggtgtgaatatgcttgtaatatgctcggtgtgaatatgctttgtgtgaatatgctgtgaatatgctcagtgtgaaaatgcttagtgtgaatacgcttagtgtgaatacgcttagtgtgaatatgcttagtgtgaatacgcttagtgtgaatatgctcggtgtgaatatgcttagtgtgaatacgctgtgaatacgcttagtgtgaatatgctcggtgtgaatatgctcggtgtgaatatgctcggtgtggtgtgaatatgcttgtaatatgctcggtgtaaatatgctcagtgtgaaaatgcttagtgtgaatacgcttagtgtgaatatgcttggtgtgaatatgctcggtgtgaatatgcttggtgtgaatatgcttgtaatatgctcggtgtgaatatgctttgtgtgaatatgctttgtgtgaatatgctcagtgtgaaaatgcttagtgtgaatacgcttagtgtgaatatgctcggtgtgaatatgctcggtgtgaatatgcttagtgtgaatacgctgtgaatacgcttagtgtgaatatgctgtgtgaatatgcttagtgtaactatgcttagtggcactgaactgtgcactttaaaaaatggttaagaatgtaacttgtgatgtaccctttaccagttttaaaaatgcatttacatatgaatatccatgcaggcgggggtatgagcttgtgtctcttcctctgtctgggccatcttccaggaaccccccaccccagccctcattatctggaatcctccatgtctcagccaccccttgtgatggttgggcttgggctgggtccctgttgctgtcatcttacatggcactgccttcctgcacaccagacatggcactgctgggctagcaaggccctcagatgtgtggtaactgccaaaatggcctgccagtggggctgttcctattcaccctttcccccaagggctgcaatgccaatctccccatggctaggccaatggtgggcactctgtacttaaaaaaaaaagtcaatctgggcaatagctcacgcctgtaatccaacactttgggaggtcaaggtgagtggatcacttgggttcaggagtttgagaccagcctggcccacatggtgaaaccctgtctctactaagaatagaaaaaattaccctagtgcagtggcatgcacctgtaatcccagctactcgggaggctggggcagaagaattgcttcaccctgggaggtagaggttgcagtgagctgagaaagtgtcactgcactccagcctgggccatagagtgagaccctgtctcaggaaaaaccaaacaaccaaacaaacgaacaaaacaacaacaacaacaacaacaaaaccccacaatctggtggtcaaaaactgaggtcttcacacacatttctctatccctggggtgggggcagccatctctctgggtgtctgtggcctttggcgtggctgtcttttcccctcttcatgtgctttggtctgtttgaaagacccctttcatggactgaatggtggcccccaataagacatatccatgttctactccctgaaacccacgaatgttacctttgatggcaaatgggtgaacatgaccttagtggctagggtgtgatataggaaaggcccctgagagcaggagcttcccctggactacccaggtgggcctcacaagggagaactatggagaagcaggcataggggtaggaggccacgtgagacagaggcagaaatcggaaggaagtggctgcaagccaaggaatgcctggagcccccagatgacgaggaagggtccccacataaggtctggtgttctggtccttggggagggcagcccctgctgaaaaggggcaggttgagacccagggaccacttcaggccctcgctggcggcccccaggctgggggcagcagactctagcaactctggccagtgcctgcacctgaggccccatctccaggcgttccctcttgtcctcccagccctgcacccgccttgctcagtgaggcactgtcctccctcctcggactggcttccagccaggcaggcactggtgagggccggtgtgggcagccctgccatgcccagggtctgggttctgaggaggtgaagcttctccccatgtcccagatacagaaactgagacctagggagatttggaaacttggtggacaccacagacttcttgaggagctcgacaagggtgatctgtgtgggtccgccctgagtggggtcctggacacagctgtagctgccccgtttctcctgggctgggctgggctgggccaggctgttgggttgtcatggtaagtaacatccggctgccaccctcagagagccatgagtcagcatggccaggatgggctagtgattggcaccttggggacagcctagcaggcggggcctccctcaggcacaccaaggtgacctggcctcggcaagaggcgtccaggcctcaccctgcaagagctgggccctggcttctgtcctgagactcgggtctgcatctcttaaatggggaatgtcccaggcgcatgaggtgcctggaaacccacaccaaattcagcgcatcagaagctcagccagggccagcccgaggaggcgtccttccaggaggccctgctgttgggggccactgcttgccagtgtctcctggtgggtggggtccaaacagctgggcctggggtcccttgggccccccactccacatggggatgctccctggggcgggctggggaggaggtgcctgctccagcagaaggaacctgggaaggcacctgttctgagggttttggggcagaggccgaagtccatgccaggctgtggccaggctggcctggctggcagggaaccacaggcttctgcacacagcaaccccttctgcaggcccagggctccctcagggcactgcagctggagttggctgagtctgggacggtcacttctcccaccgctgcccctggctgttcctctgttgctcaccagttgcccagccctgagccctgactcagagccaggcaagccaaggacccagcaggggcaggtcagaggtcagtaatatcaaggtgtgcctggatgagccaggcagaggccaggggctccacctacccacctggctggctggtggagccagctggctgccccctacccaccccacccctgcctcccacctcaggggcaagcttggatcctggcagctcatgctgactcagcctgcccagcgatggggctgggggcagcctagggcattttgagagtgggacaagatgggtggggtggcaggaagccctggacctgggacttggggaagggggctctggccccatgggtggcccttgggcctggggaggtttgctgggcagcaggacaggagcagagtgggatgtcggcttggtcccagctccacataaacgggagtcatgagcctagagagcagactggccaggtaggctgacctggggtacacaccacccgcggacccacacgccaggcagctgtggacaagggtcccaggtgaccctgctggggaaagcagcagccatcaggttctagggagccatagctcctgactcaagggaaaaaacagaattttaagtggaatcaccctgttttggggacttctgaaaactgagcttcaggccaggcacggtggctcacacgtgtaatcccagcactttgggaggccaaggtgggtagttcacctgaggtcaggagttcgagaccagcctggccaacatggtgaaaccccatctctactaaaaatacaaaaattagccaggtgcagtggtgcatgcctgtcatcccaactacttgggagactgggcaggagaatcgcttgaacctgggaggtggagattgcagtgagccgagatggtgtcactgcactccaggctgggcaatggagcgagtctccgtctcaaaaaaaaaaacaacgctgagcttcattgaggactaacttatatacaaccaaatatacccatttttgatgtaactcaatgaattctgacagacgtatacacctgtgtaaccacttccatccctctaaagcgttccttggtcagtccccccaccccagatccctcccaggcagtcaccggcactatagctttgcaggctctagaaccggacagaaacagggccctccaggtcttctgtgcctggctgcttgccgtgcgggttctttccctccttgcccaggagcacccgtgtgatggcagctgacagaagcgtctgagccacctgtgcagggggtgggggtgccccaggccccacctcccatctcccgggctgctccccaaactcctgccctgaccccagcgccactggttttgagtctcagttcccgcacagggtgaacagtcacaggaagggcaggggctgggggagccccaagcggggtggggtgggtggggcggggctggacggtgaatgtctgcctccccagccaggggctgagtcgggaaaaaggagggcctgggctagcagagctgaggttctgtggcagaccccctggcctccaggaccagaagggaagcagccacccttcacccaggccaggctgggcggccgccacaagcccccacttcccagctgccttccagatggtggctctgggcaaacctctcaaccactcagcgactttcggtgaccactgatggctgaggttcctgagctgacaatggcctgggcctgggatggttcctgggctccttggccactggagaatgaccttcccttttctgagaccctggggtgcaggcaggacacggcggccatgcaggggtgacagaggccggaggtgctgaggtcctgggggagaccaggttgcctgcaccctcgggcctccacagctccccaggcttcacgttgaggtcctgcacccagatgtccttggaactgggcagcatccacgaaccatgcactcccaaggtcagactcactggcggacacaggaacccagctcagtgaaggatgcacgcaggtgggtgcagggttctcacacacttcttactcaaaagggaaaatccagatacccccacccccagaagccacaatgttaagccctttcccctgcttgtgcaaatctgatcgaaaagtgcaaatctgatctaaaaccacccagctaggtagtgaggggcactccccaagcctgtggagcccttcctaaaaaggcactctgggcacccagtggacagggcagtgtgcagggctgtctccgcagctgaagggcgggtcactgcaaaacagcatatgccccttggattatggggtctgaccctgggcagaccaagtaaggccagggtgctgctcacccatggggccaccctgaggctggggagcctgagaccaagctcccccaggtacttcacaggatggggacggaggaacgggtgcaggaagcacagacatcaggctccccggcccttgggggtatgctgcaagcattcacttcccagcctgcacctgcccttcctgctgctcccagagagaaggcagcccacgggtgagctggaggcagcagggcggggccagccacgtggggagcaatgagccagctccacggctgccttctcatgacagcgtttcattcaccaggcggcgctgccaaggctgggattcccacggtcaggtcaggaagtgcctgtgcagcaggtgttgagtgcctcctctcattgtggatggaagagacacggggaaaagcttcagagagcaaacacacctaacatgggctttatcaggaagttctcctcttggagccttctggatctacaaagcacagtcccactaactctgagaaatgatcccctcctgggggcaggaacagtcttcccctgggcccgcagtgaagctgcctgcatacagcagcaacttaggtgtagtgggggggctacagcagcctctgcctcaaactgagctttcaaggcctcagaagtaaactgtacaaccggtcttggagccaccaatacccagggctcaacagagcccaacaggtgtgcagcacatctgagccttccccaccacattcccctgcaaagacccacatggcacagtgctgactcaatgtttcaccactttaatagaatattctaactattctgtacaaattgaaaacactgtattcagttacaaatgtgttctaaggttaggccgagcactctccacaggcctggtcagtgcggacacggccatccccggctgccggagagcgccgtcacccacttgaaaaccccacccaccagccgccaagcggtcacaccaaacccaggaccttcagacaggatgaatggtggggccccgcaatggggctactgagaaagcaggacttgacgctcatacgctccactgaaacgcaggacttcccagcccagtccctcagtggagaagactgccgaagcccggctccggcagcagggtggcgcctgcgtcatgaggacgggctcgcatcttcagccctggtggcagggagcggcgtttcttccgcacaggccttgcgcctgctaggaagtggcacatcttcctgctcagggcaccaaggtggttcagaaacgttaaggacgagccacagcgaaaagccgcagtcctcacaggcaagaagggataaataaatatgaggtgacccgcagcagctctcacctgggctggtgtgtcacaaccctgacccacccctaaaaaaaaaaaaaaatcaagaagcaacatcctaaggagaacagggccctactctacacagccctttctgagatgatcggcatacagcaggtgatgcaggctgcacactcagcagattcagcggctggaaacagcaagtgggtttcttcggatgaaagggaagaattcagtccaactgcaggaggggtgggagaggttccagatcctgggaaccacatcaccagacctcggccctttttgccaagtgacccccaccccaccctgatgtggtctacagggccctcccacagggaaaggcccagggaagtccagagctacaggcaccaaggctgcagagggtgctggacgaaacctcctatttctgaaatgcatttcagttgccactgtacaagttaagcaaaataataaggaaaaaggaaaagtgaaagtgaaaatcatgcacttgaaaacgagttagatggagtaagctctgtccacgggattgtgctgcggcaaggaccgaggccccgcccacaggcctggagtcccgacagccggtctgccaggcacccgcctccgcttcctactgctgcttgcattccgccggctggctgggttccttctgtcaatgaaaaagacaaggcttgtagagagcaaagccagctccattcaccaattagctccaatcaacaatgaaagccaagactgaatgagttcattctcattgaaaaaaatggttactgcaaatatacttttaaaaatagtgacaaaaacaaagctaactccccctaccaccctgcagtcaaagcagggtttttttttgtttttaaagctatgccttcaagcat

SEQ ID NO: 2 - DNA, 27758 bp, Homo sapiens
  misc_feature: KCNH2 gene
  misc_feature (8718)..(8817): n is a, c, g, or t
  misc_feature (14265)..(14364): n is a, c, g, or t
cctggcaaggccctccaagactcctccggttgaaattaaccaacacctcctcgtaatcccacagcactgactgcagactgcagtttctgtctgcccaccgtctccctcaaaactcactagactgtgaatccctggaggagggatcctggcttatccctcttgtcccccagcagtgtctggcacagggcccagtacttagaaagcccccagtaaacacttgtcgatgcaactagtagcagaaccagaattagaagtcagatctcccgaatcctagtctccagggccttacttgcttcttttgacaccacaaaggcagggaaaatgtcccaccaaaggtggggatcaggttgtccagagaagaccttggaatggaccaggggttggcaggattgctacatgtggagctgcagagggcgatgagtgaagagtgtcctggctcttggctaggggtttcaggcgggttccttccatcctttcttccttctttctttccttcctacttcccttctttctatcaataagccctgatcatccacttctggaggggaaacatgctgtttctttgattcttttcttctccaactccagttcacatctgaaaaaaatctctattctggggacccagttgcacagaaaaacaaaaaaaacccaccgtgttcaagcatcaagggacctgctcactctgttcttccttccccagggtttcccaggaaccattgctctgtaacctgtctctcctgtgcccagccgactggaactgcttcccaatcccctgtgggtaaccccaggctctcctgggcctgactttggtggtgtcttgcctggcccgctccttgggggacctctggcagagtgggcttccatttctctttctccttccaggatgtcctggctccatgccttcggactgagcaggagcagagagcagggtgggtaggatgctttctgcagacttttctccctaaattgtttctttttgggagctgggaggagcctggatatctcactgtagcctctctgttccctcagtcacaggcagggtgcgggagagctcttcccaggaatggtctctgaaatggctcttggagctgagatgggggtggggcagattctagaggcttaacagcccagctcttggtattagggttgggcacttttctctttgtcccagatctgggggtagcagaggtgggaagttgaaggcagtgggggcttctccatcagctcatctgaggcccagaaatgttgctttggggagagcttgccccctctcaccgtttctcttcctcagctcaattcttgagtgtgggggcggctaagtgggtctgccttcaggctctaccctgagcctccaaggaagtcagaaatctacattcagctttgacttctgagtatgtggagtgggctggggggagagagggagagatctgtctctcctcagcttgagggaacagctctcttcttgcctctgtgcacagaaggagggctaccccgtgcctgggctcctctctgtttgggaggatgaagggctcctctgactcctgtcttccctttgggataagagcagaggcctgtcccagcaacacgggtacaggagtggaggacagctggccagctcagatgagtggctccttcccttcagggcctggctctccctctcccttggtctggagagagggggaggctacagatgtccctttcccttcttgccctcccatgcccattctcagctgctggcctttgctcactttctctccatcccctggcctggacaggaggacacttcactcacacatgaatcatcctggattcatggtaggcaacccagcagccaggggtggccttggggcgtggcgggggctgggccagtcgtggactaggttctacccggaacccagatgtgttgatgcacctgatgccaaatgctacaccaaggaggagcttgtgctgtggaaggccctgggcccccgggggggtgagtgaggaaactgctggcagtggagagggcctgaggaataactgcacaggcaagagcctctggacttttttagcatcagctgtggagccacctccttctctcccactggctgcctccctgagtcactgcccacccaccagcaaataaaaaagagtgtcatctgctggccagtggccccatttggccccagtgtttgcatctttgtgctcctgggtggaaggtgagagtccgggtagggtggtctcacgacgacagttttctgcgccttcctccttcgggactccgattccttccctgccctttgttcttcccctccccccatgatggttctcgctggtgacaagacccagcccctgctccaaggacagaggcagctgcaagccctcaggagcccccacatggccccatccatctagacaggtctctgatccggctgcagggaggggaccctcggctgttcagctgcgactcctccctccccgcccgcccactcagctgtcaacactcgcctccccgccctggccttcccggggccctgcctgactgctaagtccgaggacaccgcgcccggagaccctcactcagacgcaagcaggcgatgagcaggcggcggggcagacaccccgcctgcccttgagcatccctaggcctccttgcctaaataagggagccgcagctggagcgagccagctggccggggggaggggcctgcggctaggccagggctttccgaggggctgggccgtggccgccgccgcagggccccgagcccgccgattgggcgtgcaaggctggccccgggctgccgggggagggcgggccgctcgcacccggggatcccctggttggaacctcgcgctcagggacctctctttgatcctgcagctaggaggccgcaactgctgtcagaatgtccctctctgtgcagctcctatgcagagccccacagagggctctctctctctccgtgtgtgtgtgtgtatgtgtgtgtgtgtgtgtgtgtgtgtgtgtgtgtgtatgtgtgtgtgtgtgtgtgtgtgtgtgtgtgtgtgtgtgttggggcagggggcgtgccccttctaagtttaaccctcccttatttcagagctctgctgctctggggccttcagattgtcttgcttttcctatttccagggtctcccttgactccgggctcgtcttcgagggtccaggcgttgccccggtcacccacagtaggcactgagcgcgtgctgtgtataccaagccagtgctcggcgtggtggggaaccagggcataaggacccgccgtttcccttcaaatcaggtttcttagtcgctaatctggggtgggggtggaatcccttcccccatcccggccgcctacaagccggccatggcacctgtcctcacggtttcccctgcctaagggtcccttccccctcttctgggcgcgcgagtcccaggggctccttggcagagcgaggggctggcgttgggggagcactcggcgcggctcagccaatgggaaggtcgggcgcgcgcggtggggcgggatgggggggggagagggcggtgctgcgggcgcgcggcaggcgggagggggccgggaggcgggggccggagccggaggggcgcgcgccgcattaacccttccgcggccgggccgagccgcaggcgctgcccgagccgcgggcgctggagcggctgtcggcgcggtggcaggcgggagccaggagtccggggctcgggcgggcggagcgcagcgcggggacgcggcggagcgggccccgcggctcggcgggggccggcagacaggtgtgccggcggcgggcggctcgcgctcaggcggctccaggccgggcccggggtccggagcggggagccgggagccgagcgaggacccggcgcccgcagtccagtcttggccgcgcccgtgctcggcttggccgcggggtgcggggaccacggcccggccgggccacccgaagcctagtgctgggccgggccgggccggggtgggtgggggcccgcccggcccgcccatgggctcaggatgccggtgcggaggggccacgtcgcgccgcagaacaccttcctggacaccatcatccgcaagtttgagggccagagtgagtgggggagggggctgagcggggagggggctctgggggcgggccgagctcttccgagtgtggatgggggggcgtgcccgggccgtgtgcgtcggcaagtgcgagtcaatggggcctggtgggccccaggctttggcgaggggacggcgggggcaaggcttggtgcaccggggccgtgggcaccgggccaaagggtttggggttggggcttggggcgggaaactcagctcaggcttttgggatcggagtgtgtgtgacacgctgagtgtgcagggaagggatgtgggatggagtgtgcaggtgtccccaactctgggtgcgtggacgtggatggggctgtgtgcaagggcataagagtgtgtacgacccaaaccctgggatcccgagagtccagcgcgcacactggtcttgccagatcttgactgtgttgtgccggagggactgaaaagccgtggatgcagggtcagctcataatctcttcttgtgtgtgccgtgtgtatataaccctgagcccatgtgtcacccgtgagttagaccctgtatgggcggtggggaggtgtctttgacaaggctgcgagcttgtgggctctgtggagacagggtgtcctggggctagagctgggctttgagggtaagcagctccctgtggtacccccaagttgtgggttttcttgccctggagactgtcacctaattcccttatggggaccgggagtacagcacccctaatgcctgcctggtagggaggcttctagaagggtcccagattaggcaaatgtcctgggggtgggcagcattcatgtgcctgtccctaaggctgcatgagccacagtgggtgtgactgccaagggccctgggagttgggagaggatgacattccttgtccatgaccctgtgagcacaggacaacgcgtgcttgtaacggtggttgggggaaggaggggtcagtccgatggtcagtattgtgtgaagcggaggaacaagatgatcctgagggggtggagacaatgacactggttgagggcctccctgagaggtgggggtgggcccagggggaggctgtgggcgggcctacgaggaggctgggatggatgtgggggggggtgctggattctagccctacctttgccactgactgccatgtgaccttgagtgactcttccctctttgggtctcaggttccaggtctgtggaggaggggcaggctttctgtcccatccctgtattccaggatctcagtgaagggtgtgtggtggggtggggcatgccttcgaagaaacttgctcttctttccccagcctgggagagaggacaaggggtggtttttcttctatgaagctggggtgtgtggctgggcctctggactgccttggactgtggcagagctggaggccgagttagggggtcttttcaggtgacaggaaaccctgactcctggaattgatggctgcctgggaggtctggggggccttgggaactggccaaaagatgaaccagttccaaaaggcaactttctgggggccaggggaagggagaatcgagaaaggtgggaggaggccaagtcctgatggcctgggcctatctcagggtgccctgctgcagcccagctttgcacgtaggattgcctagggctgcaacctgagggctatgcttgctggggaggggaggggaagggagggggagaattccaactgctactgaaagccccagcattacaggccaaagtggccggaaacttctgtttataaaaagctcttatcccaggagcatcttgcctggcacaagtgaggctgctgcctgcctgctgctcactcgccagcctggctctccgggcaggcctggagtcagggagccaagtctggcagaaatggaaccatgggggtgctcatccaggatgaggccaaactgaggaaggcctcacatccctgggcaggtcccctttcttgggtctgttttcctacaagtggggccaaagtctcaggccccgcccaggctccaggtgtgtccagggtttggagctgcaggtccctctctttgcttcctatgaccttgggcttctgcctgtgaccctcagcttattcttctgcctctgccagaccaaggttcaaaagctggctctatcatttacaagctgcaagacttgggcatggtgccgaacttctctggagccttggtttcttcatctataaaaggaggataataacacctaccttatggggttgtcagaggacctaatgagatgcagcgtccttaggtgttcaacgtgtaacttccctcatcctctctggcacacccacccctcagctcctgactgcccttggggcgggggtggtgtgcagaagttctagggggtactgacctggtaggatcctcagataatcggggagtgatttcctagggagcctcaggataaggagtggctcagggagcgccccccagtctggagagcagggaaattaaaagcagaatccagagagccgatgcaaagggaatcctggccgccatctctggcctttcccaggctccctttctaggcccagtgtttatccctccgccgcggctgctgacacgcgttgctgacacccgccaggctggcctcagcctcgggcatggaggaggcggcgggctgctggcggcctgcccgggggaagccacgcagcccgcccgcgggccaggcggaggagggggcgcgccgcgcggcccggccggccaggcacctgtatcggggcacacgcacagctgcgttcgccccctgctgggaccccagtcccagccatgcttcctgtggcggggagtccccgggcggctgtgtgagtggagaatgtggggaagggctgggagtcccggaggctggggtccccgctcacgcgcactctcctccccgcccccctaggccgtaagttcatcatcgccaacgctcgggtggagaactgcgccgtcatctactgcaacgacggcttctgcgagctgtgcggctactcgcgggccgaggtgatgcagcgaccctgcacctgcgacttcctgcacgggccgcgcacgcagcgccgcgctgccgcgcagatcgcgcaggcactgctgggcgccgaggagcgcaaagtggaaatcgccttctaccggaaagatggtaggagcgggccggggcggggccacgaccaggggcggggtcaagaggggcgggaccacggcgaggggcagggtgcgtgggggtgtgggggtgtgggggcggctggagaacgccccgagcccgggcagggttctgtgggggtgtgacgcgggcgggggccctgcggtgtgcctgtgggaggcgcggttccggggcctgcgcctcactctgctgagatggttttcaggagggcaaaggagttgctaggctgtgggtctggctcctctggtcctttttttccctgggcaggtgtgggcacgtagagcaagttggactagagttagaccgagctgggatggcaggtacgtgcgtggatggaggttaaaggtcagattggcagttgtgcgctgacatccgggcacaggcccctatctaccttagggcagttgctgccaggtgacaggtctgggagatgtcatggagggacaggagggctgcaggactctggctgtctctgctgcccccctcctgccctgcgcttcagcagcacctgggggaggtgcgtgcctctccccgcaacctcagttccctttgtctcagctgtcgagcgccccgccctgccaccctctcctgcgccaggtgtctttactcagccaccgcctcccagcacagctgctctgggcttccggagagcggataaacagagcccggggtggggctgctcccacaccgtgaatgccctgttggggtgggctctggtcagggcgggcagagcaggaggactggggtcctgtgggcagaatccggctgcagaggcggctctggaacgcgtgcaaaccttgctgcttcctagcgtgtgtcccataagcattgactcaacccttgtgagcctggcaggcactaggctcttggagatgggcaggacagatgaggctcctgccctcagggagcttgtctgctgtagacagtgagcacgctctgctttctgtttgggaccaggccagccagccccatgtgccagccctgtgtgctcagggttggctggggtggccctgcaaagctttgcatcctccaggctgtgcttttgcaggcgtgcacagtctgtggcatcactggacggcactagagggggcatggtccctgcaccctgtggaagaaggttcgctcacagcaaatcagggttctaactggcaggaggcaggggctgtgagactagactcaaaccctgaaggcagtggatggtttctaggggctagacactgggccaaatgctttacttctcttatctcaggcactcttcacaacccagggaggtagacactactgttgtcttcattttgggggatgaagaaactgaagttcacacagtcacacagctagaaaatagcagttgggaacggagcccacatctgtctgaccggagccctgtgcgctctgttctgtctgtcatatattgaaaatgacaccaggtagttgcaggtctatctgtatgctgtacattatctcatgtgaaattttattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgcctgcagcctccctgtcagcatggcctgtcactgacaccaccagccagtgctggccccagggcgtatgactctaggtgctaggcactaacgtggggacgggagacactgggaggcagagaagacagctgagcagagggggagctgagaggaaggaagaggctccctagggagagtgggagatgaggagcctgcctggtgggtccctggggggccatagaggagctggagcgggctgttaactgccttctggtttcattaaggacttcctgtgggcaggaggttctgagctgggccttaggtggaactgagtgcttggcctaaaaggggctccttcagaaatcagcacgggttggggggcggggggcggtggggcagcagggggcccatgtgctcaacagggagctgagggagaccaggggtgcttggcttaggggactgacctcatctggtacagggcctttggtggacagagagagactggaaaagaaaaagtcaaggatcgaggggaacgcgaggcgaggtgaagatgaaagatctagaagcagtgcttcttagactctttggtgaaggatcagtgttttttaatgctaatatgttataggctggtacatctgtgaaatacaagagcacatgcgtggattttgtggtgatgccaaattgctgtaaagtttttgaaattcttgctctcaacgtctgtccttatcttgtgtgctgacacaacggctggtgctaatctagagagaacagagagacagatagtaacagctaaccgtctgtagtgtgcggcatacgccaggcattgcctaagcgctcagcatgtgctgacttggttaatctttataactcatgagaaaagaattatatacattatgtgtatcacaacatcactgtgtaccccataaatatgtacaattattgtgtcaattaaaaagttaaaaaattttaaaaagaaaaaattattattcttcccattttatagatggaaaaaatgaggcacaaggatgttaaataatttaggaaaaaagcataagtgattaagcagcagatccgggctatgaacccagagatcgtaggcctaaagtctgtgggcttaagcactgtgctacagcgcctcgcttgagggaaaggcagaggtgctgggaggatatgaggaaatgagatagggaggaaatgagatcaaagatggcagaagaaaggatcatagccagcgtgagaaaaagtgcagccgggaaagagctagataaatcatataggcagagagaggggtaggggagcctggcagcaacaagctggggtagacagattgaggggagccataagggcggcaggcacatggccgggtgggggatcaggacgggagatcccggagaggaagggccatacggggaggcagaagtggacgggcccacttgggttccagggtccatcctgcgtggctttctgctctgcccactgagtgggtgccaagggggctatgtcctcccactctgcagggagctgcttcctatgtctggtggatgtggtgcccgtgaagaacgaggatggggctgtcatcatgttcatcctcaatttcgaggtggtgatggagaaggacatggtggggtccccggctcatgacaccaaccaccggggcccccccaccagctggctggccccaggtaagtgtacttgctttagggcaggctcaggggttcgtggtctcatttctttggggctgtgagctgtccaaggtcaacgctctgcaggaagggaggatgtaatggttgggtggggggtcccccctttggaggtgggaagtgaaccctgtaccctgaggatgtggcttggttcccctggcccaggatggacacataggggtggaatgacagggcccagaatcacaggtccttggcgtgggctagcaccgtttccctagcttcatctgttgggcttcccatcccagcatcccctgggagcggtcctctctccagcctggcttgagcagcccagggtggggaacatgaccacctgggagcagctcctcccctcagtaggaagctgtgtcctatggactcagctgtgtgtagtttctttcatctgctccttgttcatggactggccaagtttcctgggggtctgggctagctgaggagaggctttgagggaatgcccacctgggctggaccatccccttgacaacaaaggctcggagccccttcctctgtcaggatgccctctttggcttaattttaatctttccctcagcatcatgacaaaagtgctcacctcttggtttcttacactctaaaatgacagtgtcagtaaaactggccctacctgctcatcggatgccacccctgacggcagggcccctggcattgtgtcgcccacttaggcgcaggccccacgcactggctgtgtgacctccagagagtgacatgacgcctttgtgtccacacttcctcatgtctaaaatggggacgctggcacccagcggccggtgtgagagacagggatgatttatggaatccgccctgaagtgtcacttcagatatggcggtttatgatgactggattctagaatgatttttgagactcgaggtcaaaatattgtgaatggaagtggggatggggggttgcccgttcccctccttcccttacccagcggctgggggtccatttcccaggccttgcccgctccggggctgctcgcgatccccacgaccacgtgcctctcctctcccgcaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcacccagcagcgagtcgctggccctggacgaagtgacagccatggacaaccacgtggcagggctcgggcccgcggaggagcggcgtgcgctggtgggtcccggctctccgccccgcagcgcgcccggccagctcccatcgccccgggcgcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggtgagggcgccgcgggacccgttccgccccagcccacgcttcttctgctgccaggcttgctgcattctgggccctcggcttctgaccttttcactacgtcctgggtgcctgggagatggaaatcccattaagcacttatttaattccattaagtggcttgttgcgctattaaatgtccattcatcccattacattcttccactcccagagccctggtgggcccctggagctggctgtcccgggacggcctggagcagggatgccctgggcaggagacgtgcccagcctccgaacaccacctggccccctgcctgccagcgtcctggagcagaccgtttcctcttcctcttcctggtctcagggctgtctcctggctgcttccttagagtgggacaggggtctgacctctcttgtttcttgtgactcccctggtctcttgagctgaccccatggactcctgactgtgcagggcctggtctccactctcgatctatgggtggcctgcctggcctggggccctgggctgctggcctgaccacgctgcctctccacctaggggccatgcacccactgcgcagcggcttgctcaactccacctcggactccgacctcgtgcgctaccgcaccattagcaagattccccaaatcaccctcaactttgtggacctcaagggcgaccccttcttggcttcgcccaccagtgaccgtgagatcatagcacctaagataaaggagcgaacccacaatgtcactgagaaggtcacccaggtaggcgcccagcggccgggctctcctctcaccttggaggagcttggagagggggtgggagtgggctgtgatccagagccgggtggagggggctagccagtgagggcctcttggagggaggcagacctgagggttggggttggcaatctattccagagctgcgatggggggagaggggacagtctgagaagtcctggagaggggactggagaggtctggtaaagggctgggaatggcagagcggaggtcgggtggatggggtgcgtgccttcggggcacagggtgaggacagggcagttgaggctggggacatgacagggccagtagcaaggggggaaggcggcctgagggacatgaaaggtctggctgcagggtgtgtgaaggaagtactaggggccaagccaactgggaggcttcaaatgagaaggggtcacagaggtcaaggacaggagggtcctaattcttccaggccaaggtgatgtgccaggcagagggtgggcctcagtcctgtggggatggccaggatggcctcgaggggcccaactatgtccctaaagcatgggagaagcaagttttcttctcatagggaggtggtgggtacaaagatatggaagggtcaggtccctgaatcctgggccagagaagacccctcagccttgggggcattagccagcctggtcttctgtcccctcctgggtttggggtcctcctggcagcaagaggacctgcgacccctccatggcttcatccacccgacaccttatcctagcctttgggggctgggggtgggtgggtcaggagtgcagatctctgcagtgagtgagaagcctgggataatgtggaggactcctgtcccaagctgttccctcctgccccttccacagcagctgcctgggttggctcatgtaagggagctgccctgctacctcggcgggctcctggccctgctcccaccgcctggctttctgggtccctgccaggtctccagcccactggccttgactccagagcattccccctcaccccaggcccttatctggccacctacccctctcttcctcctcccttgcttctctcttggttcccacctgagcccctggcatctgccctgctcctgtgcccgctgcatgtgcccgtgagttgcggtgggtctgtgcatgtgcgcctgtatgtgtcggcaggcgtgtgtgttcctgccagtcactagcagtctctccatctctgggtgtctctgtctgactctggctggctcagcactggaccggctgggcgggggtgtcagggagaccattaatctgcggtgacaggcccggctgctggcggagggggaggggctcaggctgcgggagcgccgctgcaggagcctgggcgggctgcgggggagggggccgctggctgggcaccggcggggcgggggagcctagtgtggcggggtgggggtggggacctggtagaaggaggggccggctggaggagctgaggttccgagtgcggccgctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagagccctgtccaggggcagctaccttcttctgcccccttatcagcaggggcctggccagtgttttcttttttttttttcagtccccacttgatcactgaagggccacccacccatgggcatttgctctctgccttaaggagctgggcacttagacagcagacagagcagaaatggagcctgtgagcctgtccatgtgttccctccctgccctaggcctcagctgctcccgcagcccatctggtaccgctggaggccctgtgtccaccccagggtggtcaaatctttgactatgacccgtcttgacttctagttatttcctctaaggagatgttctcccagcagcgccatctgtgaaggtgtcttgggcaagcccagcttgagtatgaaggggagtctttgggactcatcaactatggcctccccaacccaaaagcctgagggtgtgggggcctgggagtcagtgcttctgggagcagggccagcacctctggaattcatgggggctgggcaaggccttgggttcagctggctgcccagggatggcagggagagcttggggagggggcttttgggttgagctgcatgcctgagagaggattctagggagacccagaagcttctgggacagtgtggagaagctggccggagctcttcttagtttgccttgggagcaagagggacgtgcctgctgtcaccgggtccggatggccagcctgcctctgtctgatgactgtggaggaggcagagtgtgagtgtgagctggtacaggggctgtgtgtgtcactgctgagcagtccctgtgtgcacgtccctctgtataagttgggtgccatctcctcccagctgggctatgtcttctttgtccctttgtaagagggtgggaggatgaggactgtgggctgtcccggacctgtgtggagagggggctgagggagcgaggtgtgcgagtggagggtgggagtgtcttggtctttctccatcctggttgcctggtgtcctcgggcctgtggcatgaagaggggctggtaagaactgcagtgactaccagtcagtggattggggctatggctcctggggccactgcccaggttgggagctgttgtccttggaaccctttccggtctgagactatggcgtgtgtggttgggtgtgtgggccagcgtctcagggcagtcacagtggcaggtctgcatctgcattgccggcggggagcagcactgggtgttcctgccgagtggcctgaatccacgtctgccgggaaatgttggaactgtttggagccagtcctgtgctgtgtggcattttgggaaccatgatgcccaaacctgggggtggccatttgctgtggtcgcttggctgaggggtgggcattctgatggaagctttttttggcctcctcctcattctgcttggccccggcagagatgtcatcgctcctgcccccgaggtcccatggcctgcctcacccacacctccgccttccccgggtgcaggtcctgtccctgggcgccgacgtgctgcctgagtacaagctgcaggcaccgcgcatccaccgctggaccatcctgcattacagccccttcaaggccgtgtgggactggctcatcctgctgctggtcatctacacggctgtcttcacaccctactcggctgccttcctgctgaaggagacggaagaaggcccgcctgctaccgagtgtggctacgcctgccagccgctggctgtggtggacctcatcgtggacatcatgttcattgtggacatcctcatcaacttccgcaccacctacgtcaatgccaacgaggaggtggtcagccaccccggccgcatcgccgtccactacttcaagggctggttcctcatcgacatggtggccgccatccccttcgacctgctcatcttcggctctggctctgaggaggtggggtcagcaaggaggcaggtggtgtagggagaggagaggccaggaatgtggtgggaggtagtggggtggagggggtggcgaggaggacagagaaaaagagagagagagagaaagagagaaagacagtgggagagagacatggtggcaaggcagctgcagaggcaaggtgggtaccccagcaaacctatgctccttctctccacacaagctcctcgcaggttgcagagggccacacaggacacctttttttctaattcgtccatcccaaggggccattattttgtagcgtcaccaaagtgccctagaagctggtgggagtgggcaggcaccctagggtgatcactgcacctgtcagtgcccctgtttcctcatccacactatgggggctgcctctgtcccaaagctagcactaagattaatgagacacctgtgctgggcccagtgtgggcttcacctcttaggaggagggtctaggaagtctttggggatctgacctctgatgctcgctctgagggccgcagcacctcccctcctcccttgccccccttgccccatcaacggaatgtgccccttccctgtcccccagctgatcgggctgctgaagactgcgcggctgctgcggctggtgcgcgtggcgcggaagctggatcgctactcagagtacggcgcggccgtgctgttcttgctcatgtgcacctttgcgctcatcgcgcactggctagcctgcatctggtacgccatcggcaacatggagcagccacacatggactcacgcatcggctggctgcacaacctgggcgaccagataggcaaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctgtgagtgtgcccaggggcgggcggcggggagagcccacggtggaggaacccaagttggaggaaactgaggctgctagccgggccagagtgaggccctggaacttagagactccaggggccaccatcgtgacatggtttgggggctgggtcaccagggcggggactactgaagggtggggtgtgctggagcgcagatgtacaagggcgtctcgtgggcatgtcgacgctgagactgagacactgacctggtgcggggcctgagcagggtccctgtgggtgggtggggtccctgcagaggctgacggccccacgtgcccacgcccccagccctcatgtatgctagcatcttcggcaacgtgtcggccatcatccagcggctgtactcgggcacagcccgctaccacacacagatgctgcgggtgcgggagttcatccgcttccaccagatccccaatcccctgcgccagcgcctcgaggagtacttccagcacgcctggtcctacaccaacggcatcgacatgaacgcggtgaggccaccagagcgtggccagtgggtggcaggctgggaagagtggggtggcagaggggaacctcttggcacagcaaacaagtctcaggcggtcacagtcagtagtaaggaccctggaggcacgttgcccctttttgcccatgaggaaatggaagcccttggaaccccttccctggagagctccccttttggggtgggaggtatatgtcacataggcgatggggttaaatccttgtgacagcccagggcgggaatggtctctatgccttacaaataagaacatggaggtctagagcccaagggtgctcggccaggcatggtgaagctggagtggggtcccaggtccttcccaagacactgggccccctgatgcttccgagatctcccaggcctggaggttgagatttctctgacatggaggggtgggatggtggagtagagtgtgggttggggggtcccaagggagggtgtgctgagctgcccccaccctgcccccaggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctgggtatggggtggggggcgggcactggactggaaatgccctctgcagcctcaagaggtgcgagccttctgaatatgcagtcactggggctgtggacctgggactgcctgcagggtcactgggctcctttaattcacctaaactcaggccctccaagcggggccatggagaggagccccacgtggggtgaggctgctgaactctggggttcccacattctccttcccttcaggatccgccacaaacagacactttttgcttccttaaagtaggatcaaatctagatcctctagcctgggcagtagaggaagaaatgctagcctggaagctcggcatttggtttcactaagggccatgtggttccctgcagcctcatgcctggccccttgacacatccaaagcaaagggagtcctgccccctccccccacttcctttctaccctgcctgtgcacagtgggtgggttggtgtgtctggacactgaggacttcctccccctttgcctgtccttccctcggccctgtgtgcctcagggcagatatagcaagctctttcgaccatagttgatggtaggacattttagactttgtttctcagctctgtacaaacacaaatacacacccccacaaaactaaaatcaaagtttcactacataacactgggccttactgcatgtggttcattctagcatttctgttctgtgctgtgctaagctatactactgtatgttctttcagtaaaaaaaaaaaaaaaaaaaaaaaaatgctggttttgattcactactgtgttctgatctttggtttgaagaacattgcttataagggtgcagtgattggctaagagggtgtttgggacctggggtttggggtagtcctgctggctgggtctcatttgctgggagaccctgggctcctggcccctctggcactgtcgtgcctgctgggagctgagggagggtgggctggcagattgcttccccggttgtgtgggttgggggccggctggcaggcgacccagctgaggggacatgctctgcccggggtggggatgccgggagaaggtgcctgctgcctggatgccgccccccggggctgagctccctgtcctctccatggcctccagggaagaatgacatctttggggagcctctgaacctgtatgcaaggcctggcaagtcgaacggggatgtgcgggccctcacctactgtgacctacacaagatccatcgggacgacctgctggaggtgctggacatgtaccctgagttctccgaccacttctggtccagcctggagatcaccttcaacctgcgagatgtgagttggctgccctgagctggaccccatcctcctgcttccagctgtgtggctgcccctttgctgtgtgacattgaatgtgatgcttctctgtctcagtttccctgtctgtcaaatggtatcatagagcagcctacaaaagtcccaaactcagtctttgcctggggcaaaatcacattgggggcagggaagggttttcccagagctggggcgcccagccctactttttctgtgttaaggagggagcttggggcctgaccccggtggggcaggagagcactgaaagggccctgatactgattttggttccagaccaacatgatcccgggctcccccggcagtacggagttagagggtggcttcagtcggcaacgcaagcgcaagttgtccttccgcaggcgcacggacaagggtgaggcgggggaggggaggaagggggagggcggggacaaggtgaggctgggagctggaaggcggggtgggccgtgtctgctttacccaggcctcagaccttcccatcccttcctccagtgtgcccactccacaccccagctgtccagatgctgcccatctttcagggcccctgcagctgtcacctcctccaggaagccctcttccaccctccagggcaagcctaggctttttggacttcacagggctggggtctctgtgagcactgaggaggaaagaacatagaacaaaggagggccagggagccaacgatggggctgaggccccgcagtcccagagatccgccaacccctgaagcaccattgccagtgcttgggcagtcagggggtcctgggagttcttggtcggcttgacagtgggtgcaagatagcagaagaagcgactggggacaaaccagggcttcctgcccagtcctctctcgggctcgctcctgtcccctcctccaccctcgccccctcctctctgttctcctcccctctctgaggcccattctctgtttcccacagacacggagcagccaggggaggtgtcggccttggggccgggccgggcgggggcagggccgagtagccggggccggccgggggggccgtggggggagagcccgtccagtggcccctccagccctgagagcagtgaggatgagggcccaggccgcagctccagccccctccgcctggtgcccttctccagccccaggccccccggagagccgccgggtggggagcccctgatggaggactgcgagaagagcagcgacacttgcaaccccctgtcaggtatcccgggcgacgggcgggcgagggaggaccgggcgtggcagcggtggtgcgtctaccccgctcacccagctctgctctctggctgcaggcgccttctcaggagtgtccaacattttcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggtgagggagtgcaggtggggtgggggggcacgccctggagtctggtccaggtcctggcggtgttgtctggtagagggagagggcctgtctgtgtgtgcagcagctggatccccttcttccattcctagcccagctgggggctgccacacctctagcgcggagggcctgggttgacaggctgcccctcccccctccccttccccttccccactcccggtggaggctgtcactggtgtccccacttctctgagcatcccccacttcctgccccaggctggagacccggctgagtgcagacatggccactgtcctgcagctgctacagaggcagatgacgctggtcccgcccgcctacagtgctgtgaccaccccggggcctggccccacttccacatccccgctgttgcccgtcagccccctccccaccctcaccttggactcgctttctcaggtaagctccagccctgcttcctcgatgtaccgtgacccgcttgttccccgattccagcccaaacctgctttgctgcctttctgctgggctctgtggcccagcctccctgaaccttgttcctgccctcctcccacccctgtcctcctggaggaaggctgcttcaggagctgcaggctcagggtagggcaggagagtcccccgtccaaagcccctagacagctgggtgcagggaacctgtaggctaagtggcccgcagcttcactcccctagtgtccacagcctccaccgccaggccccggagcatcgcctgaagagccagctccaacggtggtgcctgtctcacggccacgggtggtctccaagaactgactgagcccgagacgtggcggtggaggctgcataccagagtatctagggacagggtcccgggtcccttctgtgagtgacactccctggtctcaccgtcctgcccatccttgcccttggcagtggctgtcacagggtcatcttgagggtgcttggcatttcccagggtgcagaggccaagcctccaggggaggacttcctgggcctgctttgccccctctgctagagatgggccttagttgccccttgtcctctcctgggtggacctgcatgttcctggcctctgcaggatggcggtgtctgtgtcaacctccgcgtccatggtggggactcctctggctgccagaggcggcctgggatctgctccctccccacttcccttggcatccgctcccccctcccatatgctgcctgctcctgtttgcagacacgagggcccacgtcagcaaatgtgccagtctcccttcgcagccgcccccgcagagctctcaccagcagacgctcagtacccacaaacccctcccgcctgccccggccctctccctggccttcagatgcctggccgccagcctgcctctgtttctaggtccccgagttctttctggattgcgggaaggaatcttgtctctttttctgtcccagcttctgtcccaacacagagactgcttgttccaggttgggttgggctcagcggccacattccctcgggaagagacaggggcctagggttttccctgctcccagctctcttgtttggctcctgctctcagagaatgcctttctctacttcccaccttggtgcctccccttggtggcccctgtcctgctctcgctgccttggctcttgtcccctccagcttctctgcccacctgactctcctcttggccctcctgtcctcccgtccatcctctgtccccgggttctcctgcccctttccctccccttcctcctcctccatggcctcttcgcctgcccatgctctgtgtgtattgcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctcccccagcccttgggaccatcttctcctgcagtcccctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctgaggagactccagtggtgctgggagggtgtaactgttacttgctgtgtcctgtgttcctgtctggacatgcataggtgtgcctgcacaggaatccgggtctgtctgcatgcccaggcccacagggctgcccctgtatccaggtctgggtgtgtgcagtgggggtgctccctgggggctgacacaggtcatctccagggagacagaatcttgtctctgtagggccctggattcaagataacaaaaaaccccctgaaccacatgcatttagaggcagtcctgatgggacactgacctggtgtctagcccctgagggccatgtgcctctgctgggtggggcaccctggctcccacagcttggcttcacactgactgtggaagcagccctgcacttgtctccctcacccagttcctgagcctgcgttgaccctaacctgaaattggtctgagtcctggctccccctgccacccacaacttagccttatcttatccaatacaattgggccccggacacactggtgactccagccctgaccagagctcacctggtgtctggctgcagatggacctcacttgtatcaccttggtcccctgtgatcctggatctcaagaggagcttcctgaagagggtgcaaccttcagggtgactcattcccatgaccggggagcaaggcaaggcagatgtcttggggacagtgaagggtgtgtgtgcaagtgcctgcgtgtgcctgtgtgtgtgtacatgtgtgtgcatgtgctgctgggcttgtaaggacatgcagcccccagaggaatgtggtgcaatgactgaggctggtgtggagagccaatgggtggcgggcaggctgtgcccagctgggtgggtttgcaggcagggagctgccaaaggcctccagagacagagcagcttctcactgagtctttgaaacctctgaccctcggaggtgggtttgttgactgttttattttattaatttttttttgagatggagtcccgctctgtcacccaggctagagtgcagtggcacaatctcaactccttgcaagctccgcctcctgggttcaggccattctcctgcctcagcctcccgagtagctgggactacaggcacccaccgccacgctcagctaattttttgtatttttagtagagacagggtttcactgtgttagccaggatggtcttgatctcctgacctcatgatccgcccgcctcagcctcccaaagtactgggattacaggtgtgagccaccgcgcctggctgttgactgttttaaagacaactgtgccgttctcactgcccatgcctgggtggggcgggtgttggtctctgagcagcctggaaggttccctgtgcccagagcagggaggagagaaggaagggatctccccctttccagggcctgggagagacagggagaaggaagagatccacaggtcagagggggagaggggtgacagagagggatgccaggcagaaaagacaggtttgtgcatcaggatctgtcccacacatgtacacacatgcacatgtgagtgtgagcttgcttctgctcatggtttaaaagtttaacacaggccttcctggttggttgatgtgactgtcactgcaggtgggggcctagctggggtggcctagatttggtgtcagtggggcatggctctgcttatggactctggagcccagggcaggagacagacccaggcagtggcttatggggagcagtgaaggtacacacgaaactcaatgctcttcgcatgctgggctgtgagctgagccaactccccgctccctggtgctgtttcatccttgtcatggtctgcccttgtccttagagtgccttcatcttgggagtctgcctgatgcccaccactccgtgtccagcagccgggctgggtgttggtggacacagagaggagaggaagaaagggcctttgcccccctcctggctttgtagcagaggtgccaccggttatttctttgtggcaccatgccagcaccacggttagctatcttcccctaggtgagggccctgcctgggcggtggaggtctggcgtggattttggtgctcctgaggagtggatgcatgtgtgtgagtgagtgtgcatgtgtctgtgctcaggatggggtctgggcccagcagaaggcaacctgtccatgctggtcctcgatagaaatacacaggtgtcccggagtcagttcagtctggatgggtcaggctgcccagatgccccttgccaagtcccttccaggactcccctgccaaggctggagagtgggtgaggggcagtcacagtggctgcgtttgccaggtggtccctgggtccggtatgcagctgggtgctctgcccttgtgtcctgaatccctaccccagcggagggcatgttagcatccacatgaggacagtcagtttctggctggtccagtgactggctggaggtcacatccctagttggtggcaggtgcgtcagacttcaggttctccccacccatcctcccgcctgcactgcccagccacaggcaggcctgctccttggctcctcccctcatctgggctcccagagcgacaggaagtttggtggtgaggacaagggcaagccgtggtggtgcagtccctcccctcccgcagggctgggcacctggctgttaagggcctgtcatccagagctgagggttttccccaaccaagagagccagagggtgggacgggagctggagggagctgtggcaagagaggaagggatccatgtggttgtcaacacgtggcagaagcctggcgcagggccccaagctggagtctggtcaggggctgggagcaggaacagaagcaggagggcagcgtggcctgtctcgcctccacctccatccccaggcgtggagggatgcccagcctgcctatccacgtgcaagctggtctccagcacctgtccttacctaagatctcatccccactcagccgggtggtggcagctctcacatttcactgacaaataacagcaatggatagttcctgagcacgccctttgcggcaagcattattccagccacctgaaaccaaagccccagaggctgagtgacttgcccgagcataccccactcctgagagtggagctggaaggtgagcccaggtggtctgagtcacatgcctgctggtcctgaagggacaggtggacttctcccccttgcctgcagggcaaggccctctgtgccagttttgcacagaggttctcatctttctttccagactcacctgccctctcccctccctgccatgtgggtcatgctgcagccacgcgagcttccgtcctgttcaccatgttcttgcatctgccctgtcttgctctcttcttgtgacgcagactccctcatccttggtgtggaaagacccttctgtcttcccagccctagcatggacgtcgccgctcctgaggccttctgcaggtttctcagccggttgtggcactcgctggcacctgtgttaggggctccccacaccctgcctgcttgctcgtctgtcctccgtaaaggggaagggctgaatgctggtcatcttttcgcctattcccacccagcatctagcacagtgcccaggacctgatgtggccactaggcagcccacaagaccccatgtttgaggattttgcacagaaaagggagatgtcttcctgacagagttggctgggctaaaatttgcgtctgtccctggaggtcactttcttcccaaaggcttggcctctggattatggctgcctccccgcctgcctccccgcctgcctccccagggagcacaagccccactccttcactggcaatgtggctacacatgcttatctttttttttctttttactttagcacaaccaaggtaaatattaaatatttgaaagagaataacgggagcagtggggaggataaaccagagacttggaccgagagcctcaagtccattcattttgtagattgaatgttggggcctgtccatggctgccccagtctgcgggcttgtgg

SEQ ID NO: 3 - DNA, 171287 bp, Homo sapiens
  misc_feature: SCN5A gene
gtaaaaatgcagagaaagttgagtggtacttcagaattgagggagagggttaccgcagcgtagaaatatatttctagatttcagttccacaccacaaatccacaacaatgccatttttcaactgtacaaaaatctgcttatgaactggacatgatcttaatggtagtgtcaaaggccaagtttttcacctgttaatatttttccacatttgtccttgaatctgaataactttatacagtactgtaaatttaacttacatcgagtttgttgtcaattcttatgaaaagagctttctgcatgtaacacatacggttaaagaacacagcaaaggacaaaatttgcaggaacagttttggaaccaacagaaaatgtcaccttttatttgccatcttatatatatctatcagttttaccagctacttctaaatttgtacattatttgtaagggaaagaaggaaaaccctaagacttgtctaacttagtggagaatgtgtgtgttgggcttaggatggatagctaagtcttattgagctgtgttacctaacttgtatataaaaattgtaattaaaagtttgggttcacctgtttctcacagtttaaaatgatgagtaattgcaaactctggaaatgtgactagtatatgatttaaggctgtagaagcaaggaagctctttcaagtgctaaaactaaagacttctagtttttggctcaaataagtactgtttgtataccaggatatgtgagatgtaaatgtagtaggtcacttttcacccttgtagctataaaataaaaattttgtagaacagaaatagcttgtactactgaattaacaaaagttatactaaagtatcatgtttaaaaaaaaatatatatatatatacagagttaagcttgttgctgttaccctgtctggatttgaaaagtgtgctgatttatatatatatattacacacacacacacacacacacacacacacacacacatacacctaaaatggcctaaagcagacatccatgtaattacagttgcaaaatgaaaacattttggaaagaacattgtatcatagttcattcatttgcagtggatctttgttcctttttactgtggtaattttagaaatgagtgtcaagtttgaaattagatctgctaagttggggttttgctgcttgaactctgcactgggtcctcaaataaaccgatgtgaatgtagttttttccccctgtgtgaagaagcagttacaccccaacaataggaggaaaaatctagaactatttcaagttttatctttttgtatatgaaaataaaataataataaaacaatcttgtctttcttaattacgtggcaggggattggagtttcctttcatgaggattagacatgaaatgaaatggcgttcggctgcttagagggctgactcaagtcagttcctgtttggtatgtgtaacattaacagatgttaatggctgaatgcctagtctgccatggtcctgtggggctggagctaagcacaggtctccatttctgccattcagaagtccagggtctagttggggacattatgaatggggaccattctcctgaacgaactgttctgggattttgagtaagtttctgcaggttagcatattttccaaatgtccaagacactccccattccctcatcctctgccaccagtcctgtactttgcagacaaccctgagcaatattgttgtaagtggagcagagaagccttgaaaatagttgtattcaggactattgcagatgacaaactctgtcattcccaaacgttgctgagtactggagtcatttgcggagctattaaaaaatacaattatgggtccttatccccaacctggaattagcaaaccaggtctccagtttcagagatttggacttaatctcactaaaggaactcatggttccccaataataaaataatgatagtctttaatacctaacaaaacaggaaggccccagaaatcacctcactgctttctgcagtaacaagtttttttggtcgatgactctttcttgcctaagtggagaaacaccctttaaattcaccctttattatgagaattaagcaacggtttgaaacttgtggagaaagtttttgatgaccctttattcagggaccagttgcccaatatttggctgtttttgctctttcacgtttagaaagttcaccttttattagtgagtgcctctaatgaaggaaggagagcaaagggctgacatttttgatacaggatcttggagctggaaaagctgaaaggttggaccttaggagtcatctggtcaaactttccctatagcaaaggaattctttgaccaaagaaatttgacacagaagttggtttataaaaccaggcttgtctgaatgagcaagtagaagagggccaagggaccatttcacttaccctcccatcccttcctttaagtctcaggtatccctatggaacacctaggaaccttgattaaagtttacaaatcactggcccaattccaattttacaggtgggcaaacaggcccagagggagttttcctaccctgaggcaggcaacccttccagttcttgacctcttgggaccaaaagtggggttacacttgttcagaagtagaggatctggattaggaaaagccatctaatatttatctctctagtatttagcacagtgtctggcacttacaagggccttaagaaatacagtacctcagtgattgtgtatttagtaaattctggggaaagctgctgaagtagccttgaagcctacagataccagtgttgtctggttgtatttgttaggattcttggttgcaggtgacagaagccattagacaaaaaagggggtttcactgaaaggattctgggggaaatgactagccaagacttcagaaaggcaggatgtatgtgggcttcaggagcctgtgggagttggggtcataacattgcaggcctccacctgtgtcctggtatttcttccattattgctcagagcaagaccagatgcatctgctcctttgacttcttagcaggaaacaaggctgtagacagtgccagagcttttttttttttttttagacagagtcttgctctattgcccagattggagtgcagtggcacgatctcagctcactgcaacctccgtctcctgggttcaagcaattctgcctcagcctttcgagtagctgggattacaggcacgcgccaccacacctggttgatttttgtattgttagtagagacggggtttcaccatgttggccaggctggtctcaaattcctgacctcaggtgatcctccagtcttggcctcccgaagtgctgggattgcaggcatgagccactgcgcctgtgagttttacgtcacagctttgctacccagagagactactagatcgaaaatccctaggaaggactctggttgatgtagcttaaccagtcagggtccttcagaagaggtattcctggcaagggggtagcctcccatttgaggctgtcaaaataatgtgcacacttcagtaggttgttagaagtggcctcctggtcagtgaatcatcagtgggatcagatgaaagttattcctaccagttatctaagaaataggaaacttgaagtttctgctaagaactaagtccacacggaatgctagagatcatgctgcaaaatgaagactcatttgtttgtgagtggtagtccatgaaatctatcctttctttgccagcaggcgttcagcaatctggattttatattctatcaagacaaagagtagagatgactcaaacatttctaacatttatagagcacttagtgacatgcccctggtacttccctaaacattttacatgtgtcatctcctttaatcctcacaagaacgctatggtctaagtattattattccaatttaaaagagaaggttggggacagtgacacacacctggacttacagcactttgggaggccgaggcgggaagattgcttgaggccagaagttggataccagcctgggcaacataaggagacccccttctttaccgctcccccactcccgccaaaaatttagccgggcaatgtggcacgtgcctgtagtcccagctactcaggaggctgaggcaggaggatcgcttgagcccacgagttcgagatcgcagtaagctatgatcattccactgtactgcagcctgggtaacagagaccctgtcgctaaataaataaatagacctgagttggaatatcggctctggagaccttagtgtaaccatgcgcaagtgtttactcacctattaaatgagactaaaggtattttcttctcatgactatatatagcataccactaagccctctagacatcatattccccatccatcgccccgtccagtggaccagggatgaagcggggatgcgctaggcatcccggtttgtcaccagggggcgtgcgaggccctcagcttggcgggcggtgaggcgtggggtgacggggggatggcgggggccggcatgcgcgcgcatgcgccgtggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggtaagtctgtgggcccgtcctcccttcgctggcccagatttcgggctccgactcctacctggagtgtgaatggcagtccttgacggacagccttcaccgtttgctgggcccctagcctggcccttggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagtaagtatgaatgaaggaataaattaatacataattttagtagatgagttaactgcccttctttcgtcattgttcagttgaagaatacctgctatccctccaaagtgtataaaaactcatgttgcaatgggtaccttatatttgacaaaaaaaaaaaaaaaattaacacgagctcatttcttgtactttgcggatgtgctaatttaacttgctcctttggatacttggcatctagcaagagaactacccccttggggggttgaggatttgagaaggcatcggggaggattatctcgaaactgactcactgctgaatgtgtgcttggtttctcccactaggaaaaacagtaccagttttactgtcatcttgcaacagcacacatatcagtgcttcagagatgatttggaaatttgatgtgaaagactaataagatcaagtctttattcaaaagttaatgcagtagctgcattttattcactgattataggcaaatcagtactttgcctactgtctgttttcttcatctcataagtaattgcaaaaatgagattttctggttgattagacttctgagccagtcctttgtaaatcacaccgctctccttttccttataatctttcattattaagagccactaattgtgtgtgtgtgttttttttgtctctgccccccctttttttttttttttcatttttaggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtaggtggttggataaaaaaactgaagtaacagtatttatgaaagatgtctccaaatttaaaacagggatgattattaatattctcaacctttttcatatcatagcacatgtagaaaattatatttatataacttactggttaaatcaaccctgcctggcagccagaaagccagaccctttccagctgtctcagggctgaaaatacccatatcttgacacactagttgggaggctctgtcataaatattacagcaatgagcaccattcagttttaccttaacaaatatttatgtgcctgctatgtgtctggcactgtggtaacccttggggacctatgtgtgaccagagtagaggatctctaccccagtgacactttgagttgggagagtgggttgacccatcaaacaaataattttagatgtataattacaataatttttccaaaggaggtgattgcaagttagtgtagtataattaaggaacagtaaaaagtttgatgagaggctgggcgtggtggctcacacctgtaatcccagtactttgggaggctgaggcgtttgagctcaggagtttgagatgagcctggccaacatggcaaaaccgcgtttctacaaaaaatacaaaaattagctgggcgtggtggtgcacctctgtggttccagctacttgggggactgagatgggaggatctcttgagcccaggaggtgggggttgcagtgagccaagatcgcagcaccacactccagcttaggcaacagagggagaatgtgtctcaaaaaaaaaaaaaagtgtgatgagagattataacacaagaacctgattttgattagtaaggcttctctggaaaagtggactgaagagtgaacggaaattacttaggcaaggggttgaatgtgccatgggatatggagaagagcattctaggaagaaaggaacatttgcatcttcggaggcccccaatgtggacaggagttttgttcttttagggaactaaaagagtgccagtagatgaatgagggggaaggtgatgtgaaatgatgctggagaagtaagcaggtgtgtcagtttattcatgtgtccttatgtcttgatagggtcctgtagaattgccagatcttgataattaatgtcaaattggtttctaggtagattcttcaagtttacactcctagcatcattgtttcttctctctctcaaccttcacctatggtgagcattactgagctttaccaatttaatgctcattttacttgtgtttattgattatcaatgagggttaacatgctgtgaattagtcttttttggtaagttattctttacctatttcagttggggtattctcttttgaatttatttgtaaaagttcttttatttattaaggatattaccttttgtcacagttgttttgttcccttttgttatttgctttttaatttgctgtgtgttccacatattctcctttgctttaaaatgtgtgctatggctatgcatattaaaatgctgatattaaagttagtgtgtgccattctagagtgcacagcaaccagcagaataacaggaggcttggaatgtacttggtgttagacagaaactgatgtaagtgaaaactttatcaagcatataagaaaacctgggcattttatattgtataataagtcttgtgagctgtgtacttttgaggcaataaaatagagccaattaatattatttgaaaatagggagcaatgtacctgtgttttacttgattttaatgtaaaaggtcttctgttttcagtaatgatggactgagttattcagatagaatcttcctgctgaaacagaaaatgttagtatataaaaagtgtatatctgtattttttttacctttttttttgagatggatttttgctatgttgcctaggctggtcttgaatttctgggttcaagtgaccctcctgcctcagcctcctgagtagctgggattacaggtatgtgccactatgcccaactaaaagtatatcttttaaaaaatggcttaagaaaaatgaagagccagcagcatagtggcgaattgctaggttagtgttggtgggagaaagcgagaatccaaagaggtaagcgcagtcttggcaaaccaaaaccacatttgcctttgaattcacagcattatggggtgaggaggattgaaggaaagacctaagactcacccaaggtagattgtcctgtaggtcttgcagtgtaggagacccttcctgtgttaccctggaactccaaagggctacatcctcagggaagagtgaactagaactaacttccctgcccactcttagggactacatggaaggttgtcttggcactgaacggagaaaggtcaaaaggaagataaaaagtttgttccagagaaggtaaagtcaaaaactggctatcatgcagacttacagcccaaatctgtgcatcgagaggagatcagggaaccttaatccctgagcatggtttaatacggttctccactgggaatactgctagacaccttacagcagtaaatttatatcttttctcaaggaaggtatctttttaggtctttggaaattcctacaaattgcttttccagggcagtaagcaccagccaaagataactagctgtagaaggaagtgattccaatggtaatgacacttagaaatttactaatgataaatttttctgtattattctttataaagtgattctaaaaagctacatatatgatactttactgtaaactttgggatctgatactaaatttttcttggctgaatgaaatcaccttggaatcagtgacttcattgttctccattttacacttctttgaataacagtctgagtatgtttcatttgttgtcataacttttgtagtttaagaaagtctcacctcacgatagtgcaataggtagtgttaggatttgctaatgttctctgtgacaaaccattctggaggtgtcagaaaataaataaaatctgagatttcttctctcctatgtggtacccagatattctgttttagaaatttctgggtggagctcataacttaaatgtttattttgtcatggttcgagaggcagtaagcaagatatcagagacactcctctccccaaggctgtgcttgcctagaacaaattgttttgtgtctatatatatccattatttcagtacacataaacttgtcaaatacaatcgtacaaaatacaatacatgggagtcttttttaaaaaacaagagtttatttagtagccaagctttttatatagtttagtgttttgattggtgattgtttttacttaaaatactattcagaggagtttttctttaactggaaaggccagagtcaaaattatatgagatagctacactgtatgaaaagcattctttcctagactagtactttctaaattcagatgaagtatctgaactatcccaggaacttgagacatgcatgcaatccctaatactagctgcttggagagacaccagccagtagcaaccagcttgccttgcttagagaatcttgagggacatttgtctactgataacatatccattttgtgtgtttttcttcaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtgtaggcatactttgggggagggatgggaatatggggctgatgttatgcatacaacaggaattagaggtttaaaaacctaggagccaaaccttaaaacttgagaatttccatactcttatttttcttcctgacaatatgtctcttctttcaatcacataccgagacatttttaaacaggttgaatgaggaaaactaagtgctatgtgaagggaactagaaagccactgggagctgaagctactcacttttatttatttatttttttgagacggagtctcactcactctgttgcccaggtcggagcacagtggcttgatctcggcgcactgcaacctctgcctcccaggttcaagcaattcctgtgcctcagcctcttgagtggctgggattacaggggtgcgtcaccatgctcagctaatttttgtttgtttgtttatttattttttgagatggagtctctctctgtcacccaggctggagtacaatggcacgatcttggctcactgtaacctccgcctcccgggttcaagtgattctcctgcctcagcctcccgagtagctgggattacaggttcccgccaccacacccaggtgttttgtatttttagtagagatggggtttcaccacgttggccaggctggtctcaaactcctgacctcaggtgatccacctgcctcggcctcccaaagtgctgggattacaggcgtgagccactgtgctcagccactcacttatttttaattagttaattagagacagagtctcgctttgatgcccaggctggagtacagtggtggaatcatagcttactgtagtcttgaactcctaggcttatacggtcctctttcctcagcttcccgactaactaggactatagtcatgtttcatcatgcctggctaatttattttaaaaaatttttttaatttgtagaaatttatagaaaaggtgaaaaaatagtacaacaaacattgatacatttactttacatatacatatgtaaattctgcaaccattgacaaagttgcagacatgttttatttctaaatggattgctcaggagtatgcatcatctaagaatgaggatgtttatatatatgagtatatataaatacaagtatcacaccaagaagtgtatactaatacatttttatatatttgtgcagtaatattatctaaaatacaatgtatagtcagctttcccacatggtcctaattatgacctttatagcttttttgattcagtattcaatcatgaatcacacattacatttagttatcatatttctttagtcttctttaatctagaatgatttccctgccaaaaagtgggaggagtgtctttcatgatattgacaattgttgcgtaaactattggtgattatgtcattaagatagtaattctcaaccttggacactcattataatcacctggagaagtttttgcagtcctgatgcccagacctgaacctcatacttacaaaactggaaactctcagggatgagacccaggcatcaatatcaatatttttaaagctccctagattattccaatgtgcacccaagattgagagcgactgcttgaagagaaggtacttgtagcattggcagttagtatagatcagtgaggaaattacagtgaggtagagccttgtatatttgggtgaaaaatgtgaagtgaatgaacacatagtggccagatattcagaagaacaaggacgttttctctgccacttttgaactagtatgtttgtactgtactaaaataacttttgtgaaaattgatctctattgagaaactctttgccagaggcttaaaaccagaatttgcccttaagctttgtgttggaaatatttagttcttagaattcacgttataggtttggattttataattgataagcctacctgactacttactttatagtcctcattttgaataattattataagagctttctgtcctggaataattatggctttcatttattgaaacaagtagtcaataattgcctagcactaatgtttaaataagaaagtgtttttctgtgtctttttaataaaatatcttttaaaggggaaagcatttcagtgcaagttactatgtttctttctttacagaaagccatggctgaaaccttttacctttctaacattgtgcctcaggattttgataataattctggatattggaacaggtgagggatgagagttttaaaaacatgattctatggaagataaatgaagtgacaggagaatgtactgatgtgcctattagctgtttctgtctttgtttttcaaaagctaagcctctgaaggtaagtatgttgggccagttttctttgctgtgttttgggagtacagccttctacagaagatcagacttcaaaacgtagcctgcctttttgatcatgtttgccactgttcaaaagtcaagttttgaaagaaatgactcaaaataataatcttaataattgaggcagcatcttttttgagtgtgttcagtgaacactattattttctcttgtattccaatatttcttagctttttttaaaaaaacagttttgtatttcaagagctcctgagctttaggccagggtcagtggttcatgtctatagtctcagcacctggagaggccgaggcaggagaattgcttgaggccagcagtttgagactggcctgggacatagtgaagccttgtctctactaaaaatttaaaaaattaaccaagtgtggtggtccatgcctgtatcccagctactcaggaggctgaggtgggagaatcacttgagcccaggagtttgaggctatagtgagcggtgattgtgccactgcactccagtctggacaacagagcaagaccctatctcaaaaaaaaaagttcctgaacttaaaaaaagttggggtatagtttaatgtaactattaaccagtttttttgtttgttttttgtttttttgagacaaagtctcacactgtcgcccgggctggtgtgcagtggcacaatctcggctcactacaacctccgcctcccgggttcaagcgattctcctgcctcagcctcccgagtagctgggattataggcacacgccaccacacccggctaatttttgtatttttagtagacatggggtttcactatgttggccaggctagtcttgaactcctgacctcgtgatttgcccaccttggcctcccaaagtgctgggattacagacatgagccaccacgcacggccactattaaccagtttttgatagaacctaactataaaataatctgggccttctacatttttctgacactgtcaggtggcttctttatgcatctaaaactaacggtttgaggttctttcaggctattgtgtttttccccatatagtactttgtggtttaaaataatgaagagagcaccctgcaccaatgagagacttcagcagttatcagtcatggcgacatttgtttcatctacataccctcactttgccccactcagattatttttagcagattgcagatattttatccataaatgtttcgttacatatatttagaagataaggattcttttaaaatataaccacagtattattaatgcccttaaagaatttaacaataattctttattaccaattttatagtcagtgttcaaattttcctggttgtctttaattttttgttgttgttggttggtttgaaccaggattcaaataagatagacacaaaaatttggttgatatgtctctttagttcctataaatctgtagattttcctttctttttttttttcctccattcagattatctgttgaagatctaggatgtttgtcctagagtttcctttccatattctggatttgctgatcgcatacctgtggaagcatttaacattttcttttcccaagagataaatttctgggaggaaaactttaccttgtaattggacatatatatacaccctattaaaaataatttaaaaaaatttttaaggccagtcaagtgaagcagtgggagtagagaaggaacaaagaagtatgtaactggttgtgaacaattagttgtaaacaccactgcacttataccagcctataaaaataattggattttactttttagataagaaactgaggaatgaggacatgcattgttatctctcatttagaaatctcttccaactgggccgggtgcagtggctcatgcctgtaatgccagcactttgggaagccgaggtgggcagatcgcttgaggtcaggagttggagaccagtctgggcaacgtggcaaaactgtctattttagtagacactaaaaataaaaaaaaaattagccgagtgtggtggcacacacctaaaatcccagctactcgggaggctgaggcaggagaatcgcttaaacccaggagatggaggttgcagtgagctgagcctgggtgacagagtgagtgagactccgtctcaaaagaaaaaaaaaaaaaacttccaactgcagtcatatacatactttcatatgtatatgaaagtacatattacaactacttgccatttgggcacctgtaatcccagctactcgggaggttgaggcaggagaatcacttgaacccgggaggcagaggttgcagtgagctgagattgcaccattgcactgcagcctgggtgacagagtgagactccatctaaaaaaaagaaaaaaaaaatacttgccatttttatctggtaagttgacaaaaacagattttaaatgataaatcccagcattataaagattgttgtgaaactgctgtgttgtattttaattttttagagtaaattgatataaccctattaaaagcttatagagtaaattgatataaccctattaaaaatgttagttttacatatgatgacgagtctttaaaataaattcattcagtaattctggtccttgaaatttatcctaaggaattgatacaacgttgcattatataagaaatgttaacataagcccaattgtcctgcaagaggaatggttaaataaagtatatcatcttgttggaatgatacataattcttgaaagctggttgggaactatggcataaaaaaagttttaagttcatgaaatttgaattccagaatgtactctgagcgcacataaagaaaaatgtagatagttttgttagtgtatgtgatttttaagttttttctgtgcagtaagcaaactgggaaaataattgtttatatgcttataatgttttgtgccatgttcttgtttaatttctcaaatgcagtttttcttggtatctttcataggaattgatatgatttgctgctgtcttacatgtatatatgtgagaatatcatacatttttttatttgtttttcagaatagaaatgtactgtcgagagctgacagaaaggtttgaagatgtttgggtggtatctgggcctttgaccttacctcagactagaggcgatggaaagaaaatagttagttaccaggtaaggatgtttaatagtcaggtttatgttatctgtatgagattataatctcactttccattctgctttttatttttatttttatcattcaaaaaaaattttgcattctactttttaatttcacttattcaacaatatttattgaacacctattaggaatgataggcatagggaatatagtgatggataaaagcaactattgacttcaaggaactcacggtttagagtggaaaacagatgttaacaattaattacattaaagtgtgacatgctgtaatagaggtaaacacacacagtgtggtcttgtgaaaggactgatgggctctactcatatgagtcaggaacgcttaaaagaggaagtgatattgagctataccttgacagataagagtcaggagtggaccctgaggattccagaggatggagcaggatgagcacaggacatttgtggtcaacatcagggttttgagatttatatatcattcataaaaattggagcttatggtacaaaacagtgtgggtggctcaaggggtatgaagagttccataacaacaggtggacgggtgagataatatgcgactttctattctatgatgaagacttgggttttaatttttaggcactaagaagtcatagatttgttttaagcgtgggagaaatatgatatttgggttttataaagagtattttggcagcagcgtgtaaagagataggtgggaaaagggagcatttgaagaagagattagaggcaaggagatgagttaggacatacaagcagttggagtgaggaataatagaggaacacaggaaagagtaaccatgaataaataacttgtttgagtgaggaagagggagaagttccaggataacaactagattgcagaccaggctcagtggctcatgcctgtaatcccagcactttgggaggccgaggcaggcgatcacgaggtcaggagttcgagaccagcctggccaatatggtgaaaccccgtctctgctaaaaatacaaaaattatctgggtgtggtggcgtgtgcctgtagtcccagctacttgggagtctgaggcagaagaatcgcttgaacccaggaggcggaggttgcactgagccgagatcgcaccactgcactccagcctgggcgacagagcaagactccacctcgaaaaaaataaaaataaaaataaaataaaaacaaccagattacagtgttacagtgagttgaataaatgggaagaaaagcttttcttctagaagcttcttttttttaatatgcaagatatgtgagcacttttatagactgaaagagagattaaagataggagagtgtaattagtggtgtgagagcttcagacatctaatgttgctgggaaattcttagctagcctttcatattggcaatttacaaagtggtatacctgaagagcaggtgttcttagaaaaagtttaacatttaatcttatcatgcagaaatatcctgaggattcttccaagagggtggctgaaatgttatactatactgtgaggcttacagagggcagggaacaggtggagtgaagcagaagaggtggtagagtgagtaaaaagaagcactgaaggacttgctaataaggccaaagaggaggggagggaacacctagctcagctctggaaataaagtagatatttaataaatgctggttaggtaaatgattacttaagtctgtgataaaatttaataacctgaggaacagattgaggaaccaccccccccccaaaaaaaaaccaaaacttttagagtatattctgtccatttgacttgcttattatcagcctgtctagatcagatgtgcagtaatgtccaagcatccaaggatttgtataggtccatatgaatagcccactttctctttttccacacaaaattatgacccaactacttctttttgttaagtggaaatgatagagtagttgttttcaaggatttgtacatccttggaaaattccagtagatatgggagtgaaggaagtcaaaggaattagtattttaaaattaattcatttaatatctctcctcccatattaatttctctcctctgattaacttgctaatttaattttagtatattttatagtcttaggagaaaaaaaggcttaaagccccctgtattatttttcaaatattaattattcttggtctttgttaaatcctgtttattttatgtcagaaaagaggctcttctagctttgacttgtatatcttaaatggttaaattacagttttatttgtgctttgtttttataaaattgaaaaatttatatcactagcctactgtgtagtagaacaaaaatttgtacaatgtttaaaacgaaaaattaaccaataattacaagcatttcactacatagatttttgtgtggctatttctgtaaaatatgtgttgcccaaatgccgtagtggaaaatgtattgtttttcttaagttggatataatttttaaaaatagaactgataaaaatatatcttctagttgtttctgctgaaaaggcccagaagaattggtatgtcattagcaatgaacacatcttgagacccagatatttgtttctaaaaagcatctcctgaaaagactcagcgcttagagaaatgactgatttaaggggtggtacagggagagtacaaaatggaacatcatatatcagaaagccaaggaagtgctcagacaaatggtggggatatgtcagaaggacatgtgaatcagcttgaaggagctcccacttactgtatctggtgctattgaatatcaaaataaaatggattataaacctattgaattaaataagaatacatactcaataaatatgtaaatacatagggtgtaaagaaaagcttctgcataccatagaatgtcagttaataaatttgcgagaatgaaagagttatacaaatcattttgcacacatcaccataattgattcaggcaagagtcatcactagctaaaactagtgagtgaatgttttatgaggaatagggtatttacataatctaaaagtatctcctcatacattatttattaatcacaaagtaagaaataactttacagtgaagaaacatcccattacccaagtgatcaagtttagtattgctagtaatgggacttagtgaaacgctgtactcctggtgtgatgcactgagcaggataaaatatcaggcataccccaattgagagacattctgtgaaacagctgacttctactttacaaaagtgttagtgtcataaaagacaaaggctgagaaactatctgttccagattaatagattaaagagtcatgcaaacaaaatgtgtagtatgatcttagattagatcctagaccagaaaaaagttgctaaaaaggatgttattgggagaattggcaacattcgaggtctgttatctaatatacaaattagataattgtgtattttcagtattaaatttcctgatttttaaaattgttctgtgatatgtaagtaaatatctttgctcttaggaagtcatatcctgaagtgtttaggagtaaaatggtgtgcctgtgacttttaaaaagtttagggaaaagagaagagagtgataaagcaaatagaacaaaatgttaacaattggtaaatctgagtgaaggatataaaggaaggagttctttgtgctgttcttacaaatgctaagcttttaattaattcagaattttaaaattatatattaaatattatatagatatttaaataaaatattaaaagatatattaaaatagtttatcagtgaaatgatactcaaacatgttcaagctagccttaaagagtttcaaaagagacctatcagctctcctcaccctagttagtgtcataatgatcagtcatgtgaggtcagtcaagatcagcttcctgaagagtatactttgagtaatagtcttgtttcttgtttttattttaaagacttgctggtcttaggtattctctttcagattctgggcttctaaggtcatatcattagttttccatgtctcttattaatttataggacctatgcatgttcacactggcaaatctttaattcagtaagtcatccgttcagcaaattttcaagtacctgtcatgtgggaggaaggtatacagaattgtaaatggcatgctccaaacttatattcttgattactttcttcctctcctgtatttcacatcctggcagtcatctctcactcttaattactttgaaccaacaacttttattaattctctttttttaaaataacttttacttagacataccgaagctctgaacacctgcagtattgcagaggcctctaatgggtttctctgcctccaattgcgttggctaccagtctatctggagtacagaaaccatgacagagaaagtatacgttgttactttcctaatcctcggaaccataaaaaaaggaataacattaaaagaacagaaaaggaaacttcatttatactgaaattagggaatgttcacagtcctgtatcaaggaatttttcaaataatatctgcaagataaagtgaaatttggaccaaattataaaggatgttaatttgacatgtctcctcttatcaaagcatgggacagggtactagaattagtaaggaagttcagacctaccggtagtagaccacaggagaaatttctggtgtttaacttggagcttatccctttatcttgcaatagtaggaaaggcagggtggttatagttgttaaaagcacatatttcatgtcagatctggccttggatctttgctttgatacttacttgcatgtggtcctgggaaaatgacctaacttctttaaagttcagttttatctgtgatatttggatagtagtagtgtttacctcaccgagttgctagtatcatcgttagcttggtagttagcacataggaaatgttcagtaaatattagctactattactcctttggaggctaacataagaatgaagaccagtgttttttgtattctttggtgcatgtactcataaacctatgatttctaagattcttttttacttctcctttcttatctacagaagcccaaaagtcaggtgcctctttattaattttaaagcacaatttttgtagtcttctaagtcgatgcttttgagttcatgagttcatgttatgttaggagttgtgaaattagatacttacattaaacacggtttagtcttgatgcttttttttcgctcatggcattaaagtcataactggcaaactatctttccttgaaattaaacttgaaaaatttttaaattatgcaattatatgtgcataatgataaaaatgctaaatcttaaaacatgattgtggaaatatatgacattgtaatgaaattcaaacagtacaaagcagcatgaaaaggtaaagtctcacttatactccttatcccactgtccagtttttatttgttttggcacttatttctatatctcagaataatgagcactaaaatatatttttaacttgtgacctgtcgcttattaacagttactttatctctataaaattatgaaatttattgtttatttcttgcactgcactatactctgctagtcatatatacttaattttagttcttccgttggtaaactttgcatcatatactttacataatatacttgaacctctaatcttgatctaccatttatacttgtcaaggtttgtagcatttacatttatgtttgctaacgataatgtagtctgagttttgcctgtagcagagtttgtaaactgaggcctcttatggcaagtccagcccatagaggtattttatttggctcacatggtatatatatatatatttttaagtttttcatagagatagggtcttgctctgtctgctaggctggagtgcagtgacaagatcgtagctcactgtaacctttatcttctgggctttcgagatcttcccacttcagcctaccaagtagctacgactacaggcatgcaccaccatgcccagctaatttttaagtttcttttttgtagaggtgggggtctcactatgttgccccagctggccttaaattcctggcctcaagtagtcctcccacctccacccctcaaagggctggaattaaaggcgtgagccaccacacctgactgtatgttattttttaattagtttataatgtttaataattgggagatttcacataaatccagattttagcttctcttaaatcagatgactccgtaacaattggcatatactcccataggcagccagtttactagacaagagtatcaaccttctccttagattgaacacacatcttcaaatcactgtagtctttacctgccccattttactcacttacatttcctgtctagcccttgttggtctttgagtttgtaatccaagatctattagaaaatatttaaccagcatttatattattataagtgtgtatgtagtatgtttggacctataaggaaatagatataattctatatcattaaatctgtgccacttgagagagaaatattaccacaaacaacggaaaaacagaagtggaaggtaagggtggcagtgtattataattgctctttttaaaaatactttctaattcagataatttaggtcatttaagcatattatcatatgattttttaaaaaggtaaattagttttttcgtgaaaatatattcttggagccctctgactttctgttttaatttggattacttgtttcctccctccttccctttctccttcattccctttcttctttccttccttttattcaacagagacttaactaagcttttactaggtacctggtgctgttctgggtgcttctgatacagcattaaacaaggcagaaaagagtaccctcatggagcatgcattatagtggaggagatacctagtaagtaaaatgcctcgtagaaatataaagcacggtagaggattgtattagggtgggaaagaaagacaaggggaagtgagatagggcagaagcctaagtgaagtgagggagcaagccatatgaacagtttttcggctagagcgagtgcaagacacgggtgaaactgaggttggcacattcaaggagcagtgctctgctcagtgtgactagagcagcgtaagcatgaggaggagaagaaggtaaattatagagggaggcaatggcaggaaatgtggattgtattaagtgagatgggacacttaaacagtgttttgatcaggttagtagcataatctggtttacatttttaaagcacacactggcttcttgtgaagaacagaagaaagtgtggaacctggaaggccagttaagagactaatggaattgtctacatgagaaataataacttgaataggatggtggtggtagaaatggtgagaagtggtatgatttaagatgtgcttggaagtggtcagcacactgatgatgttgaaagctatgatgagattatataagtgaatatagacaggagagaacaatcaattgaattctgaaccctggagcacttggacattagcggtcaggaagaagaagatccagcgaaagagtcagaggagcagcctttaaggtaggagaaatctaggggagagtgatgttccagaagctaagtgaagaaatcatttaaaggagggaatgatgagttgagaactgactgtttgcaatcccagtaagcttttttagttttaagtcatctatatatctgtccttctgtttctccttattatactcctagcttgggtccttaaattcctctttccccttaaatattatcttaaatccctcttttccaccctcccccccctccccctgcttttttttttgagacggagttttacggtgtcccccaggctggagtgcagtggtgcgatcttggctcaccgcagcctccacctcccaggttcaagcaattcttctgcctcagcctcctgaatagctggtattacaggcacctgccaccacatttggctaattttttatatttttagtagagacagggtttcaccatgttggccaggctggtcttgaactcctgactgcaagtgatccgcctgccttagcctcccaaagtgctgggattacaggcatgagtcactgcacctggctacccttttttatagataacttttttttgctttggtagagtatatcctcaaattttttctggaagagtcaatggatgataacctttccgagtccttgcatgtctgaaaatgtcctaaaactctgaagatgcgctcaggaatctttatgtatgacaagttctctagagtagttttatgtataccaccattttattttattttaatgaggatgatccctttatttgacttgaggatggagaagaagaggattatgaggtcacgggaatgtctcatgaggaattacccaaagctggtaacaccaggtgctctgccaggaggactctctggaaggggcagccagctcacagatgccctggatccctcgaggccagtcactaaaaagttatgaccatccccttcttgccagtctgccagggctccaggggggaaaagtggaaaattatctggtcctggcccagggccagctcctcggtgaggaactcgaagaagtgggtgctgtggctgcggttctcctcagtggtgtccatcatgctggtggaggagatgaacagctgcgcccagggctcagtggacctactcagcaccatggtcaggcccgctacacccatcatgttcacatgctgcccttgttctgtgctccctggcccatgctcccatccttgggtttgcccaggatggaggctgtggcgcagagccatttctccaaccctgcaggcacttggttggcaggcaagttcgtgtctagctctaggaagggcatgggctgtagaaaaagagacccattcttttagagagtatttttctagcctcatatgaaggcaaaacaaaggcctgctacttttgtgagttgtaggataattctgcagatgaatttttttcagtcacacactttgattttgataccctttatttgctagagtactacttaaggggtggtaaaaatattaatatcagctttggctttttcctgtatattttatcttaacaatgtcatcacatccatctttcatcttccagaagttcacggtagttcttagtccagtaatgcagtactctgtcatttttcagcacttttatacctttttactgccattccatatatttatgtggaatatatatatggatatccatatatatatatatgtattttccttttaatttgcagaggagaggaccaaaaacccgtgttcaatttgccttttttaactggaaaccctactttaatctatatttattagtgttttgcaaagcaggttaatttgtttttgtctttgcttttagcaggttaatatttcttaatgttttatttggaaataatttcaaatttatagaaaggttataagaacaataaaaagaacttccctgtatctttcacctagatttactggttgttaacattttgccacatttatgctcccccatatagataggcatacacctgtttttgttttctgaaccatttgagttagttgcagatatcttgttcctttcctcctaagcattctgtcatgtaaccacagaataattatcaaattcgtgaaaaaacatatagaaatactacctaatatttagtccatattgaaattttacaaattacccaatactatcctttatactgttttttttttctgattcagtatccaaccaggattgagcattgcatttagttgtcatgtctctgtagtctcctttaatctgaactagcttctgactcagccttttgtcttgaatgactttgatatttttgaatagtacgggccagttgttttacagtatgtccctcctttgggtttgtctgttgtttgctcatgattcattatgtttttggcagaatgtaggagcagtgatcttgtgtccttctcagtgcattgcatcaggaggtgcataatatcagtttgtctgattattgatgattttaactttacttggttaaggtggtgtctaccaggttttttcaccatttccccctttggaatttataagtaatctgtggaaatactttgaggcgatgtaagcatctttttcgtcttcgaactttcactcaatagttttagcatccattgatatttcctgcctgaattagttattactatgttagttgctaaatgatgactttctaattcttactccttaatttattagttgacattccactgttagagcttttccttgttatcaatgtagactcacagatttatttttattcaaagagttttaatgtttactgtgattgttcattttgatgctcaaattgccccagatttagccagtgggagctccttccagtgtctcctgtgtccttttgatgcatcctcatcattttttagcatttcctactttctggtataaggctatgttccatgttcatcttggccatcggccatttctccaaggagcactggatccttttagtggggattgatgtttagaaaccaagatctggacagcaattcagattgattcttgagtgcttgctctgctgtttggtttgtcaggtgtgttcaccacatttatttttagccttttgtagtggatggagagagccccaaagctcgtagtatatggattccattgcctttagtggctcactgttgagaaggcctttctcctctgctttctgtgttcttgtatttcaaaacagggattgacagacactggtcattaggaaagcagttcactgtgtttgtacattgtgtatgtatatgtaaagttgaatattgacttcacgaatccatatttctggaggagcatatggtttttcagttttctcagaagcatatcaaactgacatctacttttatatatttatgtttttcactaacaaatatctccataataatactgcttttattagttttggcattatatttcaagtcaaactttatttcaggtagaattttaaacctaaaaatctttggtgtatctgttagatgaaagcaaaatatagtttgttagtaaaataaatttgaaaaattatcttgaaattcttgccaagaatttaattgggcccaaatttttatatatatgcacacacacatgtatctataaacttgggagaatttggttaagaaatagagatgtgggaggtctacctaggcaaggtgaagagatgagaagcgataggatatatgctgagaaaacagttaagttagagcgttcatgtagggaaggagacaaaaataaaaggaaagtttggggcctggtggcagaaacttcaaatgaccagctaaaaagtttaggcaagaacttcaagataattttctagcaagcagggcctttgaaaagtaggcaattaattataaaacaaatatagataaaatgatgtcctttaattattctgggaaaggggacacagcattgcccagtgctggagactggtctgtttctctcaagcaacgaataatttgaatcatgaattcccactttcaaggcaatgtcttgcaattacgtacggcaattcagagtgcttggaaagtgttttgttttctcagatctagccatttaatatttactgcttgcttacaactatactctgaaccttattttaggaagttgtacccaataaaagggtttatttagttttctgtccaggcaatgaagcatatatgtgtttttactttgggggaagtaaagcaaatgaactggcatttcttgagggccaggtataccaggcagtatgtaagtagctttatatatgcatctcattcaatcttcactacacccttacaaaaaaagtagtgaccattttcttttatagacaagaaaatcaaggctttaaggatcaagtctcaggcatatagcttataattgtcaaagagggtatccaaacatgggtctgtctgacaattgccagtcattcacagtgttactctttgaagcgctcaagtttatagtaaatgaattgctgtgctgttcatatacaaaagcttaaggttagcagataataaaagatggtgtggatggagagaggagttacaagtgatacttgctagcatgcaaaaataacagaaaatgggccaagaggaggattccttatagccaggcagaaatgtctgttagaatatgtaggaaaggatcacatcatcatagaacttgagtgaatatgagcctaagggaagattcgtagcagtgattttatcagaagtgagtcatctgacagttctaatcagaatcaccccctttattatatagctgaggtcatccctgtgctttctctgatgttcctgtttcaagaagaggttgattccagacaagtgaaacatacctgaagattctggtttggacattataaatggtctgacaagaaagtgagcttcagattttagaactcagtgatggtggtaatgttagaaatatttaacaatctgtgttcttttataacagcactttgcaaacttccattatactaaccctaaaggggaggaaattgaaaatgccctcaggagtcttgagacatcatttgaagtgatatgggagtaatatttttttttaagtctcttgctttatatttagggaaagcttttgttcatttccatatctatttgttttaatgaaagttaaattattttactggttgtctccctaccctcaccctaaattttcaagtaccattgacagcctagaaagagggtgcttgttttactgtgacttagtaggctgctaccctttggcctggaacaggtaccccagtgtgagaagtaccgtcttccagggtttgtgctgccacaaaagcatctgctgaggctctatagataacacagggggcgaccacattcttgttgactttaccacactttgtgactccctcacttttcatgttccttccccccctcaggttcggatttcctgtttatcaaactcccatggtttctttctttcacttgatcggcatgactttttaagggcgtggtctcttgatctgtccctctagttttatttttggagtttctttttttgtcttaccaggggaatgtaaccaaatatatctatctaattctagcaggtacatattttttcctcttgatgctgcttaatattttattggaggcacatttacagtatgtatgaccttacaaatggcaggcttaatatgggtattgtttgttttgggtctcttctgggtctgggtggcacaggtggtggtggcaaattgtcatttctgtctcttggatggaaggaaacaagctcaggccagtatataagaaaactagcttcaggttgcgaatgagtgccagcttatgtattgtattttctagttaactcccagttgacttccaatttttgctacagtcttgagtagagttcagtgcttcttgggaatttaatagcagcaagggtttcctttgcaaaatatttttatacctaaatcttacatgaaaagggttgtttgctgactcactgattaactagacttggtttatgttaagcctttgagtcctttgttacagacatcatttgtgcccaagttgctttctcctcctgaaaccccattgctgacctgtaactagtctaatcttgcttgattatacgtttcccccgcccccatccctctgtaaaaccatcttttgtaccaaatgccgttgtatcttttgaatgatgtccactacaaaatagctttttacatagatcttgtagattttgaaaaatttttaactaacatgtcattgtatcttcataacaattctatgagagaggcatttataaaatacaaaatagcaatccacccacggggatggctgttacgtattttgtaaatgaagaaacaagaaatgggtggacgcgacttgcagcttagtggcaaagccaggtttgaccaggtctctgggcttccagtccaccaaacctctagtagtgtttagaaacatttctggaagtctcccaatttttccaaaagtaggaaaaatttattatgtagattgagttgtctttaaagagacagctctaaaatattttacgattgatgttgttttaaaaaattgtcttaaattcaaggaagaaacggtgtgtttttctgaatacccaactaggacctgtccctatattagacagattaaagatgtttgcttcctaagaacaaagcagactgaatcagaaaagagattagtgagtggctaagtttttatttttctccttagttctagggatagtattttacccccttgaaatagtgtgagaaggtcatgggtagaaggatcacacctgtgattcctaataggaatttctgtttccatgaggtttctcaaaagtagaatcgaggtcctttagcaattgtaagagtttttaaacacctatagaaatggtacatttgcataaagtaaagctgtagaactgaaaatgtccaacgtctttacttttggctggaattttacgagcctgattagctctgcatggcagcaatgggcatgttaattatatttgaaaattgccgtttgtttgtagacaaggagtccatgaggagagaaaatcaagtgaatgttcttgaactgtactgcagtgatggggaatgtccacaaggtggcgcaaagactttgtttaactgctggattcctagctagcacctggaatacttgaagcccctttcaccttctccctctttgcaaactatggctcagctgcatctgtgccctcagttctggtccccagcttcccctgaatccccttcgtgctgttatttgggctttgtattggtacctaaccacattctacctgtagtgaaagctgaaggtcttggttcccactctaggtggtaagtttcttgagtggaggcaccagctgcatatactttaaagcatattcttttctgtatttccagcaatgccaggcacaggacctctgagttgcattgttgaattaacatcttttggttatttgtgagttaattgtggacttccatagggttctccctcagtatatttttggctttgaagagtatgtttatcttcccagctgcataaatgaatttttggggtgaaatggggattttatgtttgtagtacatagtttcatagactttacaccacaccccgaccaaccactttcagtaacttcgaagacagttggttatggaaatcattcccgtgcacgggtcttccctgaagctctgcaattggtcttggcagtgggaccttcatgtgtgacagacagcagatggccatggagttcccaggctgtgtgccatgtaggtaggagcttgaaaaaagcagaaaagaaacctcctttgtagctgtcgtgtctctgtcttatttgggctcacaagaaggaatcttgctgcaggcagagctgtctgatcaggaaagaaaactgactcttaccagggaagggcccgggaggggcagtaataccaatgagcatgttttagttggattatgtcagttattggggaccattaagtaaatagatgttgagtattttctttttcaaaaaagcctttttgttttgttttgttttgttttgagatggagtttcgctcttgttgcccaggctggagtgtagtgtcacaatctcggctaactgcaacctccacctcccgggttcaagtgattcttttgcctcagcctcccgagtagcagggattacaggcatgcgccaccacgcccagctaattttgtatttttagtagagatggggtttctccatgttggtcaggctggtctcaaactcccaacctcaggagatctgcctgccttggcctcccaaagtgctgggattacaggcatgagccaccacacctggcccagatgccaattggaaggaaatttgaaaaggtttagtaataatgttatttcattaatttcagccaaaccacacaactaatttatgttttctaggcctgaccctggctctggcttcttcattgtgtggatacctttccaaaatgtttgatatgacaacatatttagaagttctttgatcacaagcccaaggatgtgcaaaactcagagcaaacagcatttacatttatgtaatttaattttaaaaattagccctaattgaagtgatcctggagatggtaatgttgacttgacacctggctgcttctctaagggctatctgtttagttccctagtgaatttcataaactaaggccatgtttttatttctagagctgggagtacccaagcctgcagttttgacctttgaatgtttggagcaccagaagttctgattatgagatgaagagaaaatgacagcttttcttgtctattaaaaaaccaggactcactcatggcattcctttgtcctttgtcctacaaacagaacagagactgtgacccctgatctttgggttggcattattttatttttattttttgaggtggagtcttgctctgtcggccaggctggagtgcagtggtgcaatctcggctcactgcaccctctgcctcctgggttcaagcaattcttctgcttcagcctcccaagtagctgggattacaggcgcctgccaccacacccagctaatttttgtatttttttttagtagagatggggtttcaccatgttggccaggctggtcttgaactcctgacctcaagtgatctgcccgccttggcgtcccaaagtgctgggattacaggtatgagccaccgtgcctcacctggggttatattattttaaagaatgtgatcagaattgacctgttaaatactcttcttgtatgtgaatctctgagtcagtttattatttttggcagttgaatttaaattcattagaacagagtgggatggcttataagtacatttcagcaatgcattaaataagtatttttcagaaaaaatttgcgaactgttagcacaaattggcatcactaatatggctgctttgtttttaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaagggagctttgacacctgcagatggagggctgatcttgtgtcaagttaacaggaagactgcccacagatgacactgcatttgtatccctgtggatgtagagtattgggaaggcatttgtttagtttcatgcctccaaaccatgcattgtctgtgatgtatctgcccagccttctcagaactcaatgttgtacatttttccctctaggacctgaattggtcttggaggcagcttttagaaatcctctgtgtagttcctgtccacatgcactatatatttgtttcttttttctcctctcatgaatctgctcgtttctctacttctgtctacgtagaagcactcagcaactagtttctgctcattaaatgtgttctatatactaggctcagtgctttacatgtgttgtctcacaatgactctctgaggtaaatacactatccccattttacctgtgagaaaattgaggcttagagagcttagtgtcttacctgagtttcacttttccaaagtagtcatccacaaagtatgaggcagacagatctaagagaagaaagacagctgaggtagattcaaatcttttctgacatggatggtggctttttactcagaaatatatacctatttccatgggtatttgtgggcctgaggcatgcttggcaagaagagtctggtttctcgtctgctatgcaagccaaagggactttaatgttctttgaattgaaccctccttagctctgtggaaagagacagtcaggaatatttgggaattagacggcaatactttgtggggtttattagagcccatgcttgcctccagagatacagttcttttagtgaccagatactgccaaattgatgtgttcttgctttccaggtgagctttttgttcttaagattaagaaacctatgaaggatctgcagccaggcatggtggctcaggcctataatctcagcactttgggaaatcgaggtgggtggatcgcttgagcccaggagtttgagaccagcctgggcaacataatgaaaccctatctttacaaaaaaatacaaaaattagctgggcgtggtggtgcacacctgtagtcccagctactcgggaggctgaaatgggaggattgcttgagcctggcaggtcaaggctgcgatgggacatggtcatgccactggacgccagcctgggccacagagggagaccctgtctcaaaaaaagaaaagaaaaaagaaaaaggtctgcccacaaaatcactagcttattatttgcttcctgtgtgcctgcttgtctacctagcatagtaggccaaaggtccaaaggcatttagcattcctaggggaaattgtggctgtttttctgagccagatctcttgatttgggtttacacggagtcctttcatggactatcctgagtattgtcagtaaaacgtcttggggcataagaacttgtctgaatctgtcatacataccactgctgtcttttccgagtggtattacaagaaagatttttgtggtgtgtttgttctaagagaaatgccaaggctttcagataaagataagatgataatgattgacattgttctgctcttttatttgggtaaaaaaggaaagttgaggggtcagaacacagtagcctgattagtaccattctgttttgtcacactgttccccattagcttgtaccagttctcctcttctcggggatgtagagccaaaatgtcactgtgaccaaacaatctgttcaattttttctcctcaatggagaggtgatggtgtggcctgggtgtttctccaggagtgtgagtgggcagctctgtgggataagtcctaggtacctactgcccatctctagaggcgggcccccaactcccttcccctgttgctctgttctgccgacctgcattgccagcagccttggagttacttatgctcttcttgctcgttcctctccacctagatggtagaatctcttatttttagatcaatgaagtttttttttttttttttttttccactggggcattcctgagtttatttggggcacacccgggtgagggccctgcccctagaagaaggtgttgggcctcttggtgaagtgtggcttgtgcggatagtgcagtacctagtggggcagcaggaagttgatcttggagtcatggaactgcttgacggctggccggcggcacttgctggctgtggtctcctccaccttcatgatctggacggagtgggcccgggcgtggtgccaggcgcccatgtcttggtagcactgggtgacagcacccgcggtggtcaggtccccatattcccggcacatgttgtgggtgctgctctgggcgtcacagtgcagccagatgccgaagttcttcacccgcagggggcacttctcaaacacctgcccacagtagcaatctctcctgaagacttcttcatcttctttaactgagataccaagtaccaaaagcaggacttggcgacgacatgattaggtgcaaagattcgcatgtggtagaggggtagtgtatggcatttgggggtgggcaggcagcgacccaccaccttgtactctcatagtgtgcctgaggccttcatggcgtcctgtctgccctcaccgccacctgcaaaaggacagatcaatgaagtttcttaggtttttatttcttttgaaagatgctgcctggtcattgtggaaaatggagataagagcttgtaatacaaagttgcagtctgccagtcctcatttttatttatatttatttatttatttatatgatttgcacatcagacaacctttgaaaaagtttgttagtgtgtaacagtggtgtttgaaatgtatcaacactttcttcaagagttcccccaaacaaacttgaaatgtaaataattggttagaggttagaattttcctcctgtcataccgcttcagccctcaatgtggctgttgatcatcctggactcagatgcagcataggctgagcgtgagattctgcccttctgttctctttaccctcagacagtccctggtctgagggaaaggcagccgtggaggaagtgccagtctggacaggctcttctgctggaaacccacatcccaagtttctctctaccttcagtgatatctttattgtgaaattccaaactgtggtccctgaattgaggctgttgcaccaatattgttgtgtgttgccatacaacaaattgcaaaggttaggagactggatgtcagcccttaattaaagacctgcaaatatttctgccccttgcaccttgaccttcaagcaatggaaaacttgtctttccttcagacctttgattagaactctaggctgagttctatacttggaatgactctgaatgttaccatgtcacctacctgtgtcccctggcctcatccttgtgagtacataagtgtcattgatatcacctctgtgaatcgcaaacttcccattagcagcccatccctgaacctaaccctgcacccagggtgctgtttgttccctgcccaccccttcataccttcactctgtgtgtccttccccgtcctggcacacttccaagtgccttctgtatcctcactatagttcattctgatggatttggtcagggctgggctcacatcaggtgtgaaactcctgctcctgcctgtctccatgcctagcctccatctgggatgctttcctggatgtcatccttcttggagattgtctatcggggatccagtgttcctttttccagtctagccccaccttcagggagcaaacctcaggtcattagggccaagcaagatggactgcattgacacaggccccatgcaattcaggacagtgggggtgccgatgggctttcctactcctgaacatgccaactgtggtcaaggggtggactgcccctgagtgtgccaagtacctctaggggtcactgtggcctagtgtcactgcaagacttagtttcagctgtggcaccaccccagtatggaacttgcagctctgtaagccacaaagaactcagtcagcctcagacatcaggcaccaggcactcaggctggatggaatagcagaggttatcttgtccagtgggtctcatgtttggctcacatcagaatagcctaacagcttaataatgttcccctaaactttgttttgagaaatttcaagcctacagaaaagttgaaagaagagtgcaatgattgcccctccccccaaattttgtctcgtttgctttctcttttttccaaattattaaaagcaatttgctgttttttttaaaaaaagtaaattataggcatgacacttcacctttctaatacttcagcttatattacctaagaataagaacattcttattttttaatataattttaaattttattataattttaaaatatcacatctaagaaaattaccagaatttgatatcatctaataaacaattcctattaaaattggcccaggtgttccaaaatgttgtttatgcaattttttccctaaatataggtttcactcaaagttcatgttgttataactagtctcaatctagaataatctgcctcaaaaaatagattctctaactcttcttgaggttttgattctgtagatttggtgtgacgttggaatcagtattctctttttttgagagagagtcttgctctgtcacccaggctggagtgcagtggcgcgatctcagcatactgccacctgtgccacccgggctcaagcgattctcctgtctcagcctcctgagtagctgggactacaggtgtgtgccaccacacctggctaatttatatatatttttagtagagatggagtttcaccatgttggctaggctggtcttgaactggcctcaagtgatccgcccaccttggcctcccaaagtgctgggattacaggcgtgagccaccacgccagcctggaatttatattttctaaacaagtaacactgatgattctgctgataaaccagggtttcaagccagactggccctctactatacctccaccctctcccaatacatatagccactagacaggagtcctttgtcagataagtggtctttgagcttccgaatatctctaagggagtatgttctcctatccctttgggcccccagctatgcaattttctttatagtagatcttcataagatgaagttgaaaccttcccttgtaattcctacccatcaatgacaggcccaaactgccattccaggccacacagaactggctggcacctcctttcacctgatagtccttttgagatatgcagcttataaagacatgtggcatctcatgtcacgctcaggtgctcatgaatttcaggcccttcaccatcatgattttttatgccttcatgatgtggcagccacatctgagcaaagcattcaggacgcagtgatagcagtgctgaactgagtccaggggattgaccgctcttctcagggacgctccacttttcacactatataccattgcttcctgtggaactcggtccaactaactgcctcaggtctttttcacatgatcgatctgctgtcaaatcactttcccgttatgcacttacagagccaatttttggagcacaaatgtgagattttatgtgtgcccaactgttaggatttcatcgtgttacagtttctacccatcttcaagtgagttcacattcttgatgatcccgatttggccatctgacatggttagctatgcatccgagctttgagatagcagattgaataaacaagccttcaatgcgtttgttaaaagcattgaacaagacagagccatggaagatccctctggtagaaaactcactttacatggcaacccacttcacatacccagcaagtttcgtgtgataatgtgctctgatgttttctattaagttcattcctgtttgtttgtttgtttgtttacttatagagacagggtctcactttctcacccaggctggagtgcagtggtgcaattgcagttcactctaaccttgtactcctgggctcaagcaatcctcctgcctcagccttctgagtagctaggactacaggcatgtaccagcatgcctggctaattaaaaactttttttttctggagatgagttctcgccgtgttgcccaggctggtcttgaactcctggcctcaagcaatactctcactttggcctccctaagtgctgggattatgggcttgagccaagtcactgagcccatttctgtttctttagaaggaaaaacactgaattgattgcattatggagaaataagtctccatcacaatttgcctgtgagtcactctgggatagggagagtgcctgccgcatctctgggtctacatggcatgactgggccaatgtttggatgccagcagtgggcagggaggctgctggggaaacttggggtcccacataatcatctttccacttgtcagtgcgggacagttgaggacaactgacttcatccttctgaatcaggttcctcacctgcaagcaggttgagaaggacctgcaggattggttgaggattgaataagataacatgtgcagtttggtaagctcttaataaatggtagccagttactgtgaattcttgagaatgattattggtgtctgatgaaagtcatcctgatctgagagagtgaaggacagagccgggcctcagtatggtgttaacctgaggtggtggaagtggttcaatctcttctcaaatcctaagactgtgatgtgttgcaaccagccctttgagcatatccgtgctttacagtttgcagagcgctttccagttagagcttatgcagtccaccatttgaatcggcgcgattcatcccatttcacaaacgaagcaacaaactctaggaacttaccaagattttccagtttccaatctaatgtttaccctcaactcccccctcaaggttgttgcagttattttcatttgctttcttttttttaatatatatatatattttttattatactttaagttctagggtacatgtgcacaacgtgcaggtttgttacatatgtatacatgtgccatgttggtgtgctgcacccattaacttgtcatttacattaggtgtatctcctaatgctatccctcccccctccccccaccccacaacaggccctggggtgtgatgttccccttcctgtgtccaagtgttctcattgttcgattcccacctatgagtgagaacatgcggtgtttggtttttttgtccttgcgatagtttgctgagaatgatggtttccagcttcatccatgttgctttctaattcggtcattcatgcatttacccatttcagccctacagtgccctgctaactctttagaggcaggaggataatggagttgattcttttctgaggcccctgcagggttttgcaaatagtgagtgacactcaagagatgttttggagttatgcagcaagtcagaaacgtggagcttatcctgcttgagtcctaatgtgctcatttcacttgggcagggggcgcagggacacagaagggtggagacctgggtcctgctatgtggctgtgatcaagcctgggtcttgaataacacccgggtactgagcattgctgaactcatgcctgaactcccagggcactttccccgggcaccctatgttaggctctgcagtctcgtctgtggtctgaggcagtcaccctggtgggaagatggaagcgtggaggtggcagtcagagtgcgctgagcaagggcttttgtgtgtttgaccctcggagaagcagagctaaaattaggtcttccagctgtgtgcaggtgtgaagccccacccccttacctacccccaaccaggatctcagaattattcccatcctctccctcctccagccccagttactccacaggcacaggatgaaatgtcctacctctggtgatgcccggatagaaagatctacccaaatgtccttcaaggctgcaggggtgggggcagtgacaggcagtgaccttaagtttgctgagcctccctagcacctttgaggtcttggtgcaaccggggcccaactggctccttcttagaccaccagacaggatgatgttttggttccctccctgcacacatgaagggaccctggcttctcccactagcctcttgattgatgtgctctgtgcccctactctgcccaccacttcagagagagcctttgacccctcgccacccatcaccattcagacacagatggaagagagctagtctgggggcagagatggaagagccctgccctggggggtcttatccaaggcaggtggagcccaggatgatatgatttgattgtgctctctctccctgcatgaggctagaataggaacagactggccctcctcagggataaatgtgcccctcactcctccttcactatggcccttggaaccctgctctcaggggttccccagctgaggctcatactctttcatgttctggtctggggtgagaacctgccttctacttctggctcctcggtgtacctgcgataggatcttagttaagtagccgctcctcactcttcagttcctttatctgtaaagtgaggggttggggctagacagtgtccagcatccctcctctttggtgtctcttaattgtccagggcagagcaatccttggagcaaggcagcctgctgcggtggtttgcagaagaggcacagtggggcgggctggaggccgcaggggcagagtgggccgagggcctctgatgaggtgtgaatgagggaggcagagcagggctggtgtggacagccctgtcccagccctatctcccgtctgcgacaccctctccacaccccagtgctgataagcgggtgtgagccacggccgccttgtgacaggcccttcggcagggagggtgatggtgggggtccactccacttctgaattcagacgtcagcatctttttcccccaacccccattgccctgtcagactagacaggccctagcaaccaggcaccctccctgacagtccctggcttggagatttgtttctgctccatgtggcctcagccttctcagagatggtaggagacagacctccctcagtcctttctggcaaagtgccaaggaggatgaccacctcccacccccatcaggcccgttcctgcagtgactgctgatgctggggcctggcacacacagtgcttcttatcactgggcaaacttcaatggctgatccttttgtctcctctcctcaccccatctcctctatcgctgtgaccatcagcttccagtcttccccctccagctccctagcttttgggccatttctgtgtctgggcccacctctttcctctaaggccactgttcaccagaaggctgtgccagaaacctcttatttctggattcactgggatggggtggagggaacggaaaagtcttggagaaagagagacagaaacttggagctctagggaaggggaaggagaagacaaataggaccaagccagaggctataggaaacccttcagggtggagggtcttggcccaggtgtctagcccctaggctctatggcactgaactctgaacttccttccatgctctaaaaggctctcttctgtgttcagatctgaagactattttgattagcaggctgcatccatactgctccgggcagtcccactgtatgtgtctgtggggaagggtgtgcctgtcctcctgtgtgcattcctgtctatgggttccattctcagcctctgcatagcttaggaggcatcagagcatcctgagagcacagacttgagccaggcttattagcctggggtcatatctttgccatcttaaccaggtgggggagctacagcaagtagcgtaactgccctgtgccttggtttccccatctgtaaaatgaagatgacaacatggatgatagataataccatataccttgtagaactgttataagtaccaaatgagctaaaataagtaacgtgttttaaaccgtatcgggtacaatgtaattattggccattagtaatatttttgtaaattttattttaatataatttcaaacttagatacggaaaagttgcaagaaattcccatatgccctttatgcagattcagcaattgtttatattttgcacatttattttatcattctctctttcctcatatatatgtgtgtgcttatgatgtactctgtattcgtatctaccatatatagtatatatacacatacgcacatgcacacacatatttttttcagagtcacgtgagaataagttgaatacatcatgccttttttgccctaaatacttgtgtgttttggtaaggacaaggatattctcttacaaaaccatagtatagttattaaaatcagaaaatctaacattggtctaatactgttattgaatccacagtccacgtgtatatttcatcagttgtctcatcatatcttctttctttctatttctttctttctttctttcttttttgagatggagtcttactctgctgcccaggctggagtgcagtggtgtgatcctggctcattgcaacctctgccttctgggttcaagcgattctcctgcctcagcctcccaagtagctgggattacaggcatgcaccaccacaaccagctaatttttatatttttagtagagatggggtttcaccatgttggccaggctggtctcgaacccctggcctcagatgattcacccacctctgcctcccaaagtacaggcgtgaactaccaagcctggcctatttctatttctttttcctgttccagggccactcattgtattcagtttccatgtctctttcacctcctttaatctgggagagttcctcagcctttctttgtgtttcttgaatttgacaattttgaagcgtgcaggccagttatttgaagaatgatgttgctcaaatcctgttggatgcgtcctcattatgactttcaggtgatgtgttttggggatgattgctgaaggtgatgtgtctttctcagagtcttacatcaggaggcacattatgtcaacttttccacttgttagtgatattatctttgatcacttagtttaagtggtgtctgttccccctcctgtagaattactattttctctttctaagtaataagtaattgtggggagatagtttgagactatattcctcatcaaacttatacccactagtttttgcccactaataattttttacaccatcattacttctaaacttactagttggcccattcatactggctcctgtgtcttttgacatttatcttcatccgtctttaagcacttttttgctttctggcacaataagatgttccaggttttctggtgttttcctggctctagccctgaatcagccatttcatcaaggagccctggttccttttaatggagaatgatatttagaaaccaagatttgggtgctgtaggtgctcattcatatggtgtgttattgcttccagttggtcctttttattatccattcatttggatacaatggtgagggcgccactgaagaaagtgtggcttagggatggaaagggggaaaggagccagatgacctaggtagagactcccctctccccctctagctctccaggtcttccccactttctctttcctccctttccctcttcatcatgacctcatttcccttttcttgatcaaaattcctctggagattccagctgtgggaacctctgaaaccacttctgcagctacacgtgtgataccagaggcagacaactatgtgacctttgtgtgtgaaaagccaaaggcaaagacaatttatgagaaagtttttgctgagaacaatctggtgacagggtgattggggaagacacatttggaagatttccacctggacgtgttccttttccctgcctgaaaagcactcagagcagagcctgtgtggaggctgggatagggtgctgtgggaggtctgttctccagataagcctcttcaaggctctggggaccaacgaggaggatttaagtgcctggtgaagtccactctctgtgtccacaagtcacagagacagtttaaaatgaaataactggagttcaatgaaagccacttaaatagctttcttagttatgtaaatgtagggtgaagaatgagtggccttggtcccccacctggagttagtttattgttttgagactagatccaaagcctcctctccctgagatctctggtatgcaaagctggtccctggaggaagcgcatcagttgacagagggagcccagaatctctgtgagggaagaaaacactatccaactgctgctcctgggatttgaagtgaagagaatttgttgggatgaagtgaggtggccacaataaaggcgctgggccatggggcttctgaaatgagattaatatgaggaacacctgagtctagggtggtgcccggggcttacaacaagaacccacctgtgtttcctggggtaaggctgtccttagcatagtgtgaggctaactgctgggagctctggagactctgccatgctgacattgtgcctgtgctcctggccagggactgccacctagatatgagtcacagtggggggcccctgggctccagttgactttgaggagtgatactgtccctgtgaggacgctatgagtgtcctcaatagtgatgtggtagtgctggtcagacccacaatccctattttccttgtttttttgtgtgtttttttttgttttttttttttaaacacgaaaaaacaaacaaacaaaaacctcagaaagtgaaaatccctaaagggagggactggacgtgtcatgtaaattcttgattggttaacagaagaaattaaaagtggattgagggcacctttgtgctctgtgcccaagggaaagttcaaacagctgcattcacagataccagagacgccagtgtcttcaccatcaccagcgacgtgtgggtgctgcctcaacaggtattgggaacttgctcttgtttacagcttggctcctcatggtagctgtaggaggcaggatctgggtggatgggacctgggattcattcttagaataggtccccaaatggtcatccattttgcttgccgagggctctgtggggcagacgtaggaggcctgaggggctgcctgggaggtgatctgaggaagcctcttatggcactttcatggctctcctagccagagaccagagacacctcctctcccacttctgagcgctccatctaccaattttgcatccgaaatagctcccaagcttctcattctctactatccccatcctggtccaagccaccctcatctctccctatagagatcacctgactggttattctccctcattgcactttgtactcccctaccccgccatatagttttgtaactataaacagccttgtttgtggatttggaggtgaatacctgttttcctaacttgattgtgagctacatgaggacagggaccttgtctggttttatctataagatgctcaatgtgtggttgctaaacaaagagtggacagacgcctcggtttccccagctggtccctatgtaggctgatctcacttgatgggagtgagtgagtgaggaaggggaccctctggttctggagcctctcatctggccctgctgctcagtattcattgatccttcaaatgtcagtgtgtccacaggagagaaagggtggcaggtagggctggcagaaggcagatgtgtggctttatagtgatcctatgcttggggctgggtgggtttcagctggggtgtgggagcagagaaattggctttgggaggctctgtgatgggggccttgcagcaggtgggtggtgagggcagcatggaggtggtggctggcctggaagggaggaggacactgggtggctggggtgccaagagagtcctggtgggggctggtagctgggaaggctgggcagggctgcccgcaatcaagagggtgacaatgagtatgaagagtatgcttagtggaagtgaaggcctgggaggctgggaggaccagaggttcgtctcccccagccgcgcccttgctccttgctctcatcttcctcacccttcctgcaccctggccgcttgggacctcctcttctccctgatctggtctttcagaaatctctggcctctaacctctataaccccttcctctcccagcctcccagccctgtccactccccgagtcacatccccaccagccctcctgccctgcctgcagcctgggccctgctgagctgccgtgcccttctctcatcacctcctcctcgctccctgtggcaccttggcaccagccccagatctgtgtgcactgatttcccaacattcctgtcctccttcccaccccactgccccaaagggaggggctcaaggacttgagacgcttcccttggggggcccagctttcccccagagtcagggagggatgaaggcagggctgctggagggctgggcccgcagacctgtggagctgcctagtgggaggtagagggctggagtgggagagcatgcggagccaccgtgggggcaggagatgcagccctgcaaggccacactgctctccccagcttcccactgtctattggtcttgcctggtgtcacctgcccttcccagctctgcctctgacttctgcatctcccctgatcctttcagtttctcatggtccttcttatgggtgattaaggagttgggccctaggccatttctggaaggcaggagttggaggtgagcttcctgttgccttgtgtgtgtaactctagagtcccgtaggtgggtggctgctggacgtgccctgggaggggaaagggacctgtaagggtgtgtccataaacagagcgattctagaactcagggatgctactgtggacaggacttagagattgttcagcccccaccctcttccacaaccatttatagatgaaaacattgggctttaagagggaaataggattgacatgaacgagtcacgtaggggttagtaatcatcatcactgtcatcatactagacatttattaagtgcttactatatttgagggatcattgtaaattctttacaaatcttaattttcatagtcctcacactaccctgggaagcagctgttgttattttccccattttacagacaagggaacagagactggaacagtgaggtcagtttccccagatcacacagaaagcctgtgtcagagcagtggaagtttatcacacacagggaggcttgctccttccaatgatgatgtaagcgtataagcattgttgagagctctttaaaacagtggcagacatttcaccaaagaagatagaggaatagccaataagcacatggaaagatgctcacattatgggcacggtggtgcatgcctataatcctagcactttgggaggccgaggcaggaggactgcttgagcccaggagtttgagacgagcttgggcaacatagcaacacccccatctctacaacattttttttttaaatagctcatgcctgtagtcccagctactcaggagcctcaggtgggaggatcgcttgagtctgggagttcaaggttacagtgagctatgattgtgccactgcactccagcctgggtgacagagtgaaaccccatctcttaaagaagaaaaagacatgctcaacatcattagtcatcagggaaacccaaattaaaattacaagatacacctactcaaatggctaaagttaaaggaaaaataaggctggaaataataaatgctggcatggatatacagcaactggaactctcattgctgattgaaaagcaaacaaatgctttggaaaacattttgacaatttcatataaagttaaacatacactattaatataactctgaaattcaattcctaggtctttacccaagagataaaaacatagccaggtgtggtggcttacgcctataatcccagcatgcctgggaggctgaggcaggcagatcacttgagctcaggatttcgagaccagcctgcgcaacatggtaaaaccctgtctctaccagaaatacaaaaaaattatttggtatgttggtacatgtctgtagtcccagctacttgggagactgaggtgggaggattgcttgagactgggaagatgaggttgcagtgagtagaggtcatgccaatgcactctagtctgagtgacagagtgagactctgtctcaaacaaacaaacaaacaaaatccaaaacacataagcccacacaaacatctatatacaaatgttcatggcagctttattcacaatagcaaaaaatggtaaacaactcaaatgtccatcaactattgaatggaaaactaactgtggtatgctcatataatgggatactgttcaacaataaaaaggaacaactgatacagacaatgacatggatggatttctaatgcattatgctaagtgaaagcagccaggcacccaaggctacaaacgaaaattcctgcacttatatggactctccagaaaaggcaaatctataggaacagaaaatcgatcagtgattgccaggaacagcagactgaccatgaaggagatgagacaacttcttgatgtgatggaaatattgtatatcttaattatggtgatggctgtactgcttaaacatttgtcaaaactcatcaaactgtgcatttaagaagggtgccttttattgtatataagttatactttcctaaaactgattaaaaaataaaaacaatgggctgggaaagggaagaaaataggatggtcatggtcatccttattgcaaaagtgacctctaagacttggaagaggaagcaggggagctagggctgatccctgggggaagagcattccaggtgggagggaacagccagtgcttcagtgccaggccaggacatgcttggcctgctcaggaacctgtaaggagtcggtgttgctgaagtggagcaagaggccggccgtagcggggctcagacaggcaaatgggcaagggatggatcagggctgggtaagggctgggtaaaggcttttcctctgggtgagatgaggctgctagagggctttcagtgagcgtgatccgacttgattttaataggaccacgctggctgctgtgttgagagcccgctggggacaaggaccagtgaggaggccactgcaagaatccaggagagagatgatggcggctcagaccagcgcagtggcctggttgaacttgggatatatttcgaaggtagagccaacaggatttccggccggattggatgtagggtgtgagaaacagagaggaggcaaggatgacgtcaagggttttggcctgagcagctggaaatccagccgggcacccccgtgggggctgttgagtggttttaactgtctcctggggcctgtgggtgaagctgagacagagaccgaagggaggggctgagccctacccctggctctgtggctcagggaataggctgcacatactgattattccattaccctttatttattggccttattggcttttgtcatttccttgtctcctgtctggagtgacagctataaatgtgatagattgatacaggatacaggagccccaattatctctcttaaaccggcttctcttaaacagggagggctctcgggcaagctgtccctgccctctgccttctttgccacaagtcctacagtcttccttacagaagtggcctggttctgccagggggggagcgatgcctgggaggatgagtggcagacatgggccccaaggggagatggctcccaggacaaatactggaggcaagttcggccccctggccagtcgcaccaaggatcccagtgcacactccctgatgctctgcctcacacagaggccagcacagagtggggcaggcgggaagacaggacatactgctggctgctcagcccacatccggggaagggggctccactctgaccttgcatgcctttctggaatccgagccggcctgtctgtccacagaggctgggatgatggggcttttctctccggcagcaggtgcctggcagctgcccggggatgccagctccgtgagctggcatgggaggaagtgcttgtcaggatggtcattacacgtgctgggctcaggctggcctggccccgacccctgccactcaggctggcttgggatacccacatgaggatggcgcttcctgaagggaccctggggtccctctgggatgccctcggatggagcttggcaactgccagcctttaagtatcatttctgaactaagttcctcacccatcctctctgcttgactcttctctggcctgtctgcctacctctgtccctgggaaagtcctgagggccctggcccaaggaggtttgggacaggaagcctgacattcattctcgggatttgaggcatctccctgtgcccctcctcatccttgacagactgactacagcctctgtgccttgcatgtgcacaagtgcatggtgaatccacacgtgtttatctggcaagaatttcaaatggtcctgtgtctgacctccttccagaaaaacagagtggaaggtgggactgctggtgagaaaaggggcaggaaacttgaggggacaagaagggttcaaacggaggagcaggtccaggggaactcagcagagagtgaattggctgatcaatcagtttgtttcttctgcaaacattcccagctccttatctgtgccaggtgctggggcaggggctgaagactgtgttatgaacaaacaggtctggcctggccttgcacagcccttagactcacaggtgggctgcacagtaagtgtgcttagagcaatggtggggtgcaaaggtaccgtgccagcacacacagactctcagaagcagccaggggcaggagacgctagttcctgctgttcctctgagcccatcagtggctgccctttggcatctttgccaccacacccttgcctcactctcagttgctgtccccagttgctgtctctgcctgtaggagtgcctgggcttctgtctccctggcccctcccaacctcctgggctttgagtctcgtggccatcagggctgatatcggaggagctcctggcacgggggtagggaagctgccaacactgctgtggcccccagggtgagagctgacgtctgtccaggagcatctctctccctgccaagggctgagatctctgggctgcatgctttcccgctgacacaggagccagcatccgtcactcacagggccacccgctgcctggaccccagcctcaccccagagtgacccagtgacagctgcagccttgctgcaagcacaggcctcctctccctgcctcagccacttcccaggctcactcactccttccaggtgaacccacccacatcccaggccaggtgagggcccacctcaggcagccagggaagaccccacccaaggggccgagaagcgtgggctccaagccttggtttcaagaacaatgcgggaagctgcccgctggcccagaccaaggtggtagttaggatccctggagcttgtgagaaagacctgactcccctcacagcctcacagtggggtcccagcctccagcttccctcctttcctcacacataatagtcattgagttaccaccatgtgccagccactgagctagtcccgggatgcagtactgagtaaagcagacatagactctgttcttgtgctgcttttaagtttttttcactgaggttcctagtaagaagtttattttctatcactcaccaggatacacacatgggcactcacccacattttatatagagctgaatcaacagtttctccaaacaacactcactcttaccacatgggatatactgctattttaaattctgatattctttttaaaaaaaaaaaaacaaaaaaaaactggacatagtctgccatttgaaaagctctcgtgtggctggggaaagatgattagcccagtggtgaatggactatccctgccccggtgtggaccaaggaaccaatatcagaggtttcagggcaccgaaccacatgcctctcctatgaagttggtttacaagggaaataaatggcgccacccacttgggcccctagtcacatcaaggatataaaaaggggtctgagagagtggagggctgcgggaccctgggagtcagtttcttcggagagagctgctgctgtgctgtttccaggaccccagccttcccttgcaggaggttctggcaaggcttgtggcaggcacataccaccttctaactctgggcaggccaagggggcttccagaacttctcagagagctttaagatgttggagacacagagaactgggcctccaggatccaagaaagctcaagtggatgagcgagtgtgatctgactcccgccctgggaacccagaggaagggttgcaggccagctgcactgggggtggctgcagagggcactgctgtcagggcatgaccccacccagagtaggtggggcaagtgctccaactgtttcttatgggccagaggtgggcaggcgaagagagagccagtgtgcaccactgtgacagggccacctggagggacaaggggtcttgccaggaagggctaggctcatggttcccatgggcaaaggaagacatcataagggggtacccagaagagagagcccacaaaaatgccttgtgtgagagcatccctaaccatctgcctggcctggggaggagaagccaccagccaccctgtctctgacaagtcatgggatcgaatgctctcctggcctggctgagtctgtgtttataacacaaactgactgattaggtaaaataacctaagactgagctgcaaagctacaggatctgcccgggttttctccagggccagggaagatgatcgccactgaataaagctaaagagacaggaagggacagagacaaaggctgggttatattacatcagggattgtgtttgttcacataatgactttgcaggtatttgcaaggagtgtggagggctgtggcagggaagcatcaagagtggggcacatggtggggaggggaccgggctgtgtcaggggaggttcccagaggaaggggcattcagggaggtctgaaggctgagtggaaaggagaagagtgttctggcaaggctgggaggaggaggagcctggagcctttgaggggttggaagagatgctgttacagaggttggcaggactggggagacctctgaggggtttgccttgatcctgaggcaatagaaagccactgtgcagtcttatccagagggtaattatcttggatgaaaatatcactctggtagctgagtggagaagagtttggaatggatgaggttagaggaaggagcttccctggtggcctccatgaggcgatatgctggcctcacccaaggaagggacaataagatggagccaaaaggtgggatttgaaagacacgaaggaggtggagccaatggggcttggaccaggtgaggggtgagaggtgagggctgcatgcggctgaggatggatttgtgggaccaccttcacagataggctcagggtgaggcagaggagctcagagttggctgggctgggcctgaaagctctggagatgtccaaagtaagcagctgaatctgctggcctggggatccaaggagagacctggcctcaggaaaagatcaagactcttcaaagccataggaggggaaaagaacgtgttttccactctttctgggagagagcacagggcctaaagaacttgaacattagtcagacaccagaggatgttctgccaggggaggctgaaaaggcacagtcaataagatgggaggagacacaggcaacaaaataaaaaatagacaatggagttcatgaaaattaaagttttgtgcatcccaagacattatcaacagagtaaaaaggcaacccacagaatggggaaaaatatgtgcaaatcatatatgtgataaagaattaatatccagaatatatagagaacttctaaaagtcaacgacaaagaaaacaaccaaattcaaaggacctgaatagacgtttctccaaagaagaaatacaaatgacgaataagcacatgaaaagatattcagcataactgatcattagggaaatgcagatcaaaactacaatgaggccgggcacagtggctcacacctgtaatcccagcactttgggaggccaaagtgggcagatcacctgaggtcaggagttcgagaccagcctggccaagatggtgaaaccccatctctactaaaaacacaaaaattagctggtggtggctggtgcctgtagttccagctactcgggaagctgaggcaggagaatcacttgaaccggggaggtggaggttgcagtgagctgagatcgtgccattgcactctagcctgggcgacagagtgggactccatctcaaaaaacaaaaagcaaacaaacaaacaaaaaaactacaatgagataccatctcagacagattaggatgactgctatttgaaaaaaacagaaaataacaagagttgatgaggatgtagacaaactggaacccttgtgctgtgggagacagtatggcagttcctaaaaaaattaaaaataaaattgccatatgaaacagcaattccacttctgggtacctacccaaaagaattcaaggcaaggtctcagatatttgtgcactcatgttcacagtagcattatttacaatagctaaaatgtggaagcaacggaagtgtccctcagtgggtgagaggacaagcaaaatacatacaatggaatattattcagccttaaaaaggatgtaaattctgaaaatttatgaaaaaaattaagaaaaaattctgaaaatcctgaaaaaaattcctaaaaaggaaggaaatatgttgtgacctggatgaactttgaggacattatggtaagtgaaataagccagtcacaagaggacaaatattgtatgattccacttatataaggcacttagggtagtcaaatttgtcaaatattatatgattccacttatataaggcatttagggtagttgaatttgtcaaatattgtatgattccacttatataaggcacttagagtagtcaaatttgtagggatgaaaaagcagaatggcagctccctggggctgggggaaggcaggagtggggagttagtgtttaatgggtgcagggtggtaatttgggctgacagaaaagttcttgacatggacggtggtgatggtggtaccacagtgtgcatgtgcttactgctacagaattgtacgcttaaaccatggttatgatggtcagtgttatgctctctcagcaagttccccagacttgctcaggagaaggccatctcccaggccctcggtcctctgctaccactcttgtcaaatctcagcacaaggacagagcctagaccaggtcatgtaagccatttattggtttgttttaaaaatatgtattttatttatacatgaagtttggtgagaagtgctcgattagttcagacaacatctggcacttgatgtctgtccttccctcctgctggtcattgtgcagttctggaaattaaaaaggtgacagccaggctaaaagctaagggttgggtctagctcacctcccacccccaaccacaccgtctgcagccagccccaggcacctgtctcaaagctcccgggctgtccacacacacaaaaaccacagtctccttccggccagctgggctggcagcccgacctgcctcccaaccgcattcctgcctgtgtagcaggcggtgagcacccaggaggggcacatacctctccaagccttgagagcaaagcatggagatctacaaaaataggatttccacttggagaaatgtcgctgggacagttaaaccgtgtcccacactggactcaaagggaacacaggagaagagaactagatctgtcaggggcatgggttgggtctggggttgccaccaagggaactggggtgacaagaagaaacataatactttactcgccggcaatgcccccttcagcactgccacaaatgtccagccctccgacagctcggcgaggtaggttaggagcagccagcccagagccggcaggtgagactgaggtggcctgggaggcatgcgcccggtggaggggctccatgggagagctggaatggggcagccaagcccctgcctgctcaggcttcgccagttgaccctgttacctcagggtgacagttctctatgttaaaagatttgcatatgctaaataggattgtcagcagctgaagaggtcctgggggtgattggactagtaaaatatttttccctgaaaaagccttttcacaagacctatgggaccacctggatcttgccccaaagaggtcctctgtgtgggtgccatcaggatcccgggctgagccagagaggctgggcctgaccacagtgccccctctctcaaaggtgccatggttcattcccctctaagggcacgagaactgggcctgaccatccctttccctgcacagggcgcagggccaagctccgctccccactcccatgtctctgtgtctggagaggagctggagaccacacagaaaactcctccgcgtatggtccagagagccctgggagatcgccagtttcctctcttcaggcaggctgaggggccgccatggctcagggctggtgaacttcttagccccaaacccccatggctcagccctctcttccgatggctggctgggcagggcctgccaggttccaggagcaaggacaagctgcatgccaggccgtgaatggggcttgcacccttgtgtcctttggttttgttaatactcttacaggaggggaagaaaaggcaactatcagtgcctagggccagccctgggacccaggccactctcctctggaagccttttatttttgtaggactgacaatatgacctgcgtgaaaacacagggggaaaatgggaccttggagacaatagggggccagagtgagccccgtggacaagaaccccatccttggggggccggcagggaaaggcctgtctcccttaggctgggagcctgggtcccacggcctgtgtctggcctccgtgtgtgaggactgtgtgtgtgtgcttgtgtgagtgggggttcagccctcccagcatctcaggtcaagtgggagggggaccccattcgacccctgggcagtgaagacctgtgggagccacactggattccacttctgctttgagaacagacttccggctgctccatagacactcttgttcagggttaagaagagacagcgtgaattgctgcccatgtccatggaaaaatccttagttctttgctcaagtaaaaaaatatcaaatataataaatttatgaaagcccattcacaacatatacagtctcagttttatatttcgcctcagcagctgggatgaagttgctttccagagccgcagggcattgcctgaccagaccaggtcacaggtctatctgaggcctccaagcacaggccaactgctccggctgtccacgcggcgccacagaactctgcctggttgatccgcggggctgaggcccatttcttactcccaaagccaggaaggccccaggctggtttgtgactgactgcatttaggtttgccatggtgaaaaaggctgcttttcagtgtgtcctggccagccaggccgaggctcacacgatggactcacggtccctgtccggagaaggggggaagtcggcgagatcttcactgtggctgtagtcagacccccgcacctggaggttatcgctggtggctctagtgacactgtcataggagggtgggaaggaagtggaggagatggaggagctggagggtgggccaaggggtcgggagaagttctcactcatcacgtaggcgatgaggccctctcgctcaggggcatcctcttcggagaggccgctgcccgcctgctgacggaagaggaaggaggcatgcttcaaagagcgttgcagcaggtgcctgcggaaggctctctggataaccatggccgacacctcttcgtgcttgcgccggagtgtggtggtgatgggctcgtaggagatcttggatgggttggctgccatgaacttctcctccatctggatcttcagggcgtccatctccccagactcccccaggacccttttggtgaaggcaaagagaatgtccatgcaatggatgcggtccccactcaccatgggcaggtccatgttgatgaggcttatctggttgggcttggcgatacggagtggctcagacagggcatcggcaaagtcagacaggaccgaatactcaataaactgagtggcctctgggtcaaatttctcccagatctcatagaacatatcgaagtcgtcctcactcaggggctcggtgctctcctccgtggccacgctgaagttctccaggatgatggcaatgtacatgttgaccacgatgaggaaggagatgatgatgtaggtggtgaagaagaggatgcccacggctgggctcccgcagtccccccgagagccattgctgttgggcagagtggggtcgcagtagggcggcccagtgttgaggatggggctgaggaggccatcccagccggccgacgtggtgatctggaagaggcacagcatgctgttggcgaaggtctggaagttgaacatgtcgtcgatgccagcctcccacttgacataagcgaagttggccatgccaaagatggagtagatgaacatgacgaggaagagcagcagcccgatgttgaagagggcaggcagggacatcatgagggcaaagagcagcgtgcggatccccttggcccctcggatcagtctgaggatgcggcctattcgggccaggcggatgactcggaagagcgtcggggagaagaagtacttctggatgatgtccgagagcacagtgcctgtgggaaacaacagagactgtggctactggtggcacctctgtcttccagccagcatcactgtgcaggggttggcggtggggggggggtctctatatggcaaggagccaaggagaggcggcccttccaggattgcgtccactgggcatgctaggactctgcctgctcctgtctgtttgagtctccatgtctgcatctgtgacccagaaaaatgggtcctttgcagggttccttctcagccccctcattccttaatcttcagtgtgtacctacacaatagagctgtcctaggcccatcttctacatcttgggttctcaggccagaggggatctgcttagtatcttgcccacccagcttgggccagaactcaggtcttttagctccttgctattcaaagtgtggtttgaggaccagcagccttgggatctcctaggtgcttatcagaaatgcagaatctcagctccaccccagcccattgcatcttaagaagcccagatgatttatgtgcccatcgaagggcatgaaacactggcccagaaatcagtgctccctgatgccacgccatggccagtgtcttctctcagcttctctgtgatggttcttatcgctctcctaactctgcctcctttgagggcgtcactgcccctgggtctcctgtgactacctgggtttggagttttaaggggcatggatataaatcatggaataaagagtgaaataaacttgtcttatatggcccaagtgccctttccagactccttatataataatgtcactgactgacatgggtccagtgtttacgatcactggggcaatgggccgagcactttatagccatcatttcatttagtccttcccattgtcctaggaagtgagcagatgccatcatccttatcttccagaagaggaaacagaggtgaggtaacttacccaagttgccacctagtgagtgagaagctgggatttgactcagacgttcgggctccaagttgatctcttaaccactcctcctctctggtaccgcccaaacagcgggccaggagagatcccaaagtacatgctgaaccttccaaagcctctgagactgtccctcaatggttccattcctgctgctgacatcctgcattctctaaaactcctctccagtcccataaggcacgctctcaccctcatcctgcttgagaccccccagagattcctgaccctactttgtgcttccatcttcccgtcactatagccacagcagtgcctgccttagcccctgcattatcctttacatttaccagaggcagaggttgtatatggcagaaagatgaaagtcacagtcaccgcaaggcagagccccttgggggtagagttaaagagtttgggctccgagcacaagtgacaaaagaaaaaatataagtaaactggacttcattaacatgtaaaacttttgtgctttaatggacaccactaggaaatgaaaaaactcacagactaggagaaaatatttttaaatcatatatctgataagagactatgatccagaatatgtaaagaactcttacaactcaacaagaaaaagagaaataacccaattaaaaatgagctaaggatctgaatagagatttctccaaggaagatatataaatgaccaacatgcacatggaaagatgtcctgcatcgttagtcatcagtcatttgcttttgcaaaccaaaacctcagtgagatatcacttcatactcactaggagggctcctataaaaagaatgcaggcaataacaagtgttggtgagggcaaaataattggaatcctcatacattgacagcgagaatgtaaaaaggtgcagccatattgaaaaacagtttggtggtccctcaaaactttagataagtggttttcaggggtgagggagaggggaaatgaatggggattgactattaaatgggtagagtttcctttggggaaaggaatatattctaaaattagatagtggtgatggttgcaaagctctgtgcatatattaaaaaacactgaattgtatactttaaagtgactttaaagttaaccgtgaattttatggtatgtgaattatgtctcagtaaagctgttatataaaaaaaagatctgggctccgaggtcaaacagacatgggtcaggattgggtctctgcttctccctagctgcacaatctccctcctttggtgctgaattgactgggtgaattgcatgaggcaggtgatgtctgaaggagtctggcatacaccttggcggttagctccagaattttccatcttcagggataatttctactctggagggccacctatcccccatccctggggacccatctcatcctgagcttccttctccttcaacctaagtgcaggcagaattagcctccacagcacccactcccattcccagactcatccttgaagctctctaagcagttagagaactgtgttcccagttcctctggagggtggggccaggagcaagtgctgggtcctctgccagattggtctccttggcccaagtggggccttccagataagttctctctggagaggtgtgtgtgcgtgtatgtgtgaggggagaaggggggtgagaaatgcactgaaaaaaattatgaaagaagctagggttgtacatggcattcagcagagacccaggggctggaggagaggcctggctggggagggcttctccgtccagctgacttgtatacccacccacgatggagaggatgacaaccacgaagtcgaagatattccagctgttggtgaagtagtagtggcgcagggcagccagcttgacaatacactcgcctgtgaagatggccacaaagagcaggttgatcttggccaagatgttgattttctcaggactttggtcatctgtctccaccatcatggtcaccatattcaagcagatcagaaacatgatggtgacgtcaaaggcctgcttggtcacaatgtcgaatatgaagccctggtacttgttctgaaaggagaggcaaatggaaagtgctcagcagggcccttggggaggctggcaaatgcctgttgctgcctctcatcccagaccacccaccctcccactctaccctctagtgagcccaaagcccctgcaacactgccacagagagtgcagaggaaaaagtcctggaggctaaagccactggctgtcctgctgaaatgcttcctgggcttcaaggcccatccccagagctccatcttccatgaggccttccatgatggatcttcagggagagattgttcctgccctgagcatccttagcacactgttcattgtgcttcccttttagttcccacagtctgaaggctcaagggcaaatttaaacttcaaccttagtaattatgtcagtgcttagattaatatattttctccacttttttatggaatttattttatttattctactaaccatatttgtatgtgtctttaattgtaaatcagcccagattatttggggaaagaaataagattttatatatatatatatatatatatatatatatatatatatatatatatattttttttttttttttttttcttctgttctcccacttggaaaagattataaataacacacacacacacacacacacacacacacacacaattttttggataatggcttgattgggccaagggagtcagtcttggagaggaccccgctctccagagctcttggctctccccaccaggtgactcaggaatccggctccctgactgttctggggttccaaggatgaggctgtgagtggggtggggtggggctgtgaaggctgcactgcttttcctggggaaagcctgcatccttgaggggaaggaggagatttgctcaggtacagagggttcctgtgggtggggagtgtcctgggatgctacatccttatcataccttcctccctatctctacgaggctgggacctctcttcatgatcagacatctgatagtgcccctcaggctgggctgaaagactgtgaagcggctctgatggctggccatgtggcacgaaagcttcccagggaccccagaagatcctccccactcccacaaaaccaggagcctggctcaccaggggccgtgggatgggcttctggggcttcttggagcccagcttcttcatggcattgtagtacttcttctgctcctctgtcatgaagatgtcctggccccctaagtgcaaagagaaggcaccaacctcattctggggttctcagaggccccagcatggagggcaccaggatcttgccttcttgatgaggatgccaggattgaccacctcctggctttctctcctggacaaaatatgtccctattctgcaccacagattcttccccaaatctatttatccaggggccctgtcccttttcaccttgagatctctctggctttatgacctgcaaatccagtatccacccccctacccttttctcctcccagctcaaccagccttcaggttctctccgttcacttggtttgcctacaacccagtcatagcctctctgatgaagctctgggagcccaggccctctgcacaggccttacccatgacctctgatcatggaccaggtgaagagttgcagctctcaccccagcttctcccaggagtctcatctcttaggtggattagggcaggcatggggcctcccaccaaagccccttcttacgttcttacaggcctaggcatgttacatccctggacacacccttctccccacctcattccagcaggagcaagaagaggaccatccccaacagggaaggtgagatgggacctggagcctgagtggcccctcaatcccctggcacccggccccaccctacccagcccagtggggagctggtgctctacgtatctttttcttctgttggttgaagttgtcaatgatgacaccaataaagaggttcagggtgaagaaagacccaaagatgatgaaaatgacaaaatagatgtacatgtagaggttgtattcccactgaggctgctcttcatactgcaagggagaaatcacacagggagatcagacaggctggggtctcgggggtcacatggggaggggtggggagcagaggcagagggctgtctaggggtgtccattctgtgggaaagagggtgtatctagaggaaggtcactagcccagttatgtgagtctgtgggccagaggtgggtagggatagaggtgagaggagtggatggtggcaggtgaggacagcagacatgctgagctcagggctggcagagtatcagtgcctggctccggccctgggccaatgggaggctggagtacatggggacctctgtcagtcttcactgggctgtcagtgtgatcgggtggggtgctggacaaagaagaagcttgatttgtgtctctgttgcttccaccccatcctcctggggtaaaagtcagtaaactacagtgagtttaatttgaaagacatttgagaattctgggacttcttaggagaccaagcaaccttgccccagagccaggcttgggcattccagagaggctgaactccagagtgacacgagatcttgcccttgtgggctgggctttcagatgcagacactgattccctggtggccaagcaaccaggagcctcaggtgcctgacttggtggaagaagccactgtggcaacctacccccctggagtccacagctgcatacataatgtccatccagcctttaaatgttgcctgggaggaaaagacaagattaagacaatcatttaattctgtacctcgcttgagcttcttagggctctggtctggacagatgaagccagaagcaagcttcttatgaaaagcaagccaccccacctcaccccttcagcagcatctaaatgcctgggtggtcagagaaagaccttgtttagcactaggggtggggaggggaagcagctgagaagatgccccaagaaggccatgcagcagggaataagcttcttgattgaggccgagagtctgagggggcttgcaggaggtctgcccttcagatccaccctcatttccatttctaaaacatcacagaatcctgacagtgattctgtcagggagacagaggtggaacttagactctgtgttctagactccagggctgacctggtcccctttgtcctacatgtcagagaaccatgtggcttctgctccatggactttcaagggaagttcccgaagaatctcaaccttcccttgtacttaagggggttcttttgtcaatggtgtgttggtaaatggttaacagctgacgtcccagaagaaaagaaaaaaccctgattgttggtttgccaatttctcttgtgtaaatattctcaccatggtcgatttcaggttaccaatgtgaagttactcaatggagttgagaagagatggaaaagagcttagcattatggtactcccactgtacagacataatagaagtaaaaagcctcaagagcatagatgataatactaaaatgtaatgatgaatcttgagtatttattacctttgttttaatatcatttagttaattttataagtttatagaattcaattttttataatggctgtatttaataaacagcttgcaaaatttctgaaaatgtaacaatgagctcttgtgagctggcacaagctggctccagcataccacaccaagggagtaaagagggaggctgaaccagagggggccctagtgctggtggcattgtctgccctagtctgggctgctatgcagaaagagcccaagagacacgcttggtgtgagactgactccccagtgaagtctcatttgtgtttttggccaaatccagtcctgccccgagccttttttttttttttgagacagagtctctctctgttgcccaggctggaatgcaatggtgtgatctcagctcactgcaacctctgcctcccgagttcaagtgattctcctgcctcagcctcctgaatagctgggattacaggcgtgcaacaccactaccagctaatttttgtatttttagtagagatggggtttcaccacattggccaggctggtctcgaactcctgacctcaaatgatccacctacctcaggctcccaaagtgctgggattacaagtatgagctaccatgcctggcccccaagcttcctttctaagcacaagctcaggtacacaaacttcctgtgtcgaagaattcttatgaggcaggtagggcagaaggggaagctgaggccgcccatagtaggcaagctactccagctccctgtaccaagaggcccttgcctataaagatagccccgcaaatactttggaaactgctggggaccacccaagggtatgagatatttatgactgaattcttcccaaacaccgagtggctttgtctggaaaggtcagcagttcttagtctacaaaaggaggccttttcttccaaagttctgacattctgagggacaattgcaggaatagacagctccttgggtttggtgctaatctaccattctccactaggcagtgcaggggagtctttgtgggactaccactggggcttaagggatgggtggaggtgtgagtggatatataaagtttccagtggatatagaaagtctgctgagttttcctctgctttggggaccagagacaggtgtctgggcttgagattggaacagcaagacaagcaagttgcagctctatgcattgtggttctattgcattggtcaaggctaatggtaggttaattttatggaatgtgtgataatcactgaagccaccatactcacaaaatcagtggaaaccctagaaggattgtgcgtgcttaaacattgcacatcaaagatggaaatatattcttttttttttttttttttttttttttgatggagtctggctctgtcgcccaggctggagtgcagtggtgagatctcagctcacagcaagctccacctcccgggttcacgccattctcctgcctcagcctcccgagtagctgggactacgggtgcccaccaccacgcccagctaattttttttgtatttttagtagagacaggttttcaccgtgttagccaggatggtctcaatctcctgaacttgtgatctgcccacctcggcctcccaaagtgctgggattacaagtgtgagccactgcgtctggctggaaatatgttcttttaaacaacacaagagctaacactatattttataacagagggtggccacagtcacaactttgctaatagttcagttcctgagtagtctatggtctttcattttttaatctgtgccatcatactgcctaactgatagcctgaagagatcaacttgactactggctgggagtcggttctacagcaccacagaccatccccatactctgcaatttggagaacatggtatcggttctagaactgaaagtctggggatttcccaaggagccaaatccctggagagtcctgagcctcctttgggcactgtgatcctcctatgaagatccagcatggccccactgccccctcttcctgcccacatcatgggtgatggccatgctgctcaacagccattgggaggaaggaagtcccttctctccaggacttaccacctgcagaagggccaggtacccggcccccacgttgtcaaagttgactttcaccttggtccagtacaattctccggtcaagttcaaggactcacactggctcttgttgttcacgatggtgtagttcaaaggcaagtctccctctgtctggttgatgcacctcccaaacttccccgcaaagaggttcacgcccatgatgctgaagatgagccagaagatgaggcagacgaggaggacgttcatgatggacgggatggcgcccaccagggcattgaccaccacctcaagtggacagagaagtggctcagttcctgggggtgcccagagcacatgcccttttcaagaccccctgccaccccaagaaagaatgaactccctggctgcagggggctgtgcaggtgggtgtgcagatcccacactcaagggagaggccagctccatggctagaagccctggtggggagtgaggggagtgcaccctagagtctggtgtggcttcagaacatctggtttcccttcttggccctgccctgaatctgtgttctttaaaatctgattttcaccaaggtgtgtgctgattgaggataccagcaacttgatgggaaaggacctctcaaaacatgtccccaagactgggtttcctaacaatcccatgagtccttacatttttggagctaaattctggtttattttaggttgttgctattgggatggatgggacctcagtgcagtgtctagagggggttgtggcagttctccagtgctcccataagagcagagccagaaagcaggtggcatgggtactccctgtgatacccgctccccagtgaggggctctcagatcccatggagccacagcctcatgctctgcatctaaactcacagcaccctggagaagattccctaatagaggcatttgggaccctccaccccactcatggaccaagtccccagctgtccatgcaccaggaacacatgtgccacacagactggaggtgaagctggtgtggactgtgtggtgtgggccagatgccaggttgggggatgctgttccccagcaggcacgctgaaccctggaacagggtggaaaacccagctcttaggacaccaaacatctgggtgtagagtgaggtggggaagccctgggagtttgcccttggctggctctgtggccaatggccaccgcagaggcattcctggcacctagtgtctcattgcgtccctctggaatcaaatgtccttgctcccaaagagacatttaactctgaacattatcttgtggatggtttcccaccaggaataagctatgtgtgtctccatggattggcggtgtgggcaaggttcaaagccatcaaccaactggtaggctgagctgtgtgatggtgcctgctgggtcagtgagagacaaacaaacatgtcttctgaagccacacagaactggtatgttttgttaaaaaaaatatcccacgcaagtaaacacaaacacacacatgtgtatttgttttcttgctatatatcacggctgatgtttttcttggtgcgctttcaagtctgccttatctgctctcattctttggtaaaatgtggtgacttgaaaaatgcatagggatctgcactaggaaaatggtgcacaggagatcactaagcacgtggttatttcctctacagcctctgtctgatgctgggaatgcagcttgctctatgcctcttccctcaccctcccgaccacagcccctgtctgatgctgggaatgcagcttgctctatgcctcttccctcaccctcccgaccacagccccactggccatcacagacagagggctggcagcctgtgtctgccaggaggcagggcatgcagaggggcacacagagtgggcacacagagtgggcacacagagatgcagccctgcaggacagcagaagcacaggggccctggtgccagtggcctggggtgtagctgagacccctgtgcccagcaagtcttgcttcctctcctttgtccggtgctctcccagccctcatgggagctcacagggcttgagggtgagccctggaggtgggttctcacagctgcctagcctcagggtgcctccatgcccagctgtgcctctcctggaggttctgggccatgctcctaccaagtcagcctcggccacagtctccacggccataggacatcagaagcacagggaggggtcctgggtggcagtgggctgggcctgtgggaccgcctcccactccctggtgggaaggcagccacctctcttaccctcatgccctcaaatcgtgacagagctctcagaggacggagtgcacgcagcgtccgcagtgacttgatggggcccatctcggcaaagcccagggtgttggccaccaggctgaccagagagacctgggggaggcaaagtagaaatggggaggatgggaacagctccccactgttggggacagacagtaggccttctggtcccactaagacggtgctgggtgcgagagagccacaggcctcctgtgtccactctttattagtcctggggtggactgtcatcacaggccagctctgcactgggccaggcttcccagagcccaagctggggcaagcccaagagtatcctggcttctgggcctttactgagaggctgctatgtgtacttcacatacatgctctgtaataaccctactaaccctgcgatgttgcgatgcgccacctctattctacagatgggaaaactgaattccaaagccactctgctggtatggcagagcagggacacaaagcctgggcttttggtctccacattctttccttcaattccaattcttggacctgtctccttcgccaaagaagccttttttggggaagaagaggcagtcctgggttaagtaggagcaaatagacaatcgtggggcgtttccccaaggccagactgtgcagcatttcaacatcttcaaagaagatggggactgggtggcaccaggagcctcagctctctgttccctctgccccagcccctgagggcacttccactctgtggattttatccttctaaagctccatgggcatccactcccttcttacttcaccgctggcctgtgatcacaggccaaaaatggcctgctgcctgacctcccctgcagtcaccattagcaccacccgggtgctcaggccagcctggggttcggagaggctgggggcagaggcctgactcccacagcctcctcccgggcttggcagcaccaggggagggagctgagcaaagaggccaggggaaggaagacacgccagactgatttctgtgttgcccccactcacccctcaaggatgctgggctattggcccccaatcctggagagtcggggggcatctctcagggacctctccttgagggcaggacctccagagtgccaggtccagctggtctgcctgcccagttcctaataggctgccttgcggtctctgttctttccaaagcttgccccgtctgccccggcgatggcttcccatctcaggtgacggcaactccatccctccagctgtgcaggccacaattcttggcgtcctccctgcctcctctctgtctctgacaccctgtgtctaacccatcaggatttcctgttggctctgccttcaaaatacatctgaagtccaagtgtttctcaccacttctactgccaccgtcctggcccggccaccatcgtctctcactggatcatggcctgagcctcctaactcttctccctgcttctattcatccctctctaccccggcctccatgaccgagtgactccctaaagaaaatcagtcagttcacggcactcttctgttcagagccttccaattccgcccccctacccccatttcattctaaatcaaaggccatattttttcaaaggcagcaatctggctgcatcccctgcaatctggcctcatctcctgcgcttccttctgctcagtggctctagcctccctgcatttcccccagtatgccaggcatgctcccgacacacggtccttgcactgctcttccaatctctgcttggaacgtctgccagacattggcctggctaaccccaacttcaaacccgctcaaatgtgaccaaagtgcgcctactctgatcatcctatttaaaagtggtaacctgcaccttcccctccaccccaccccttcccttcccaagttctctttgctccatggtagataccactttttcacataatgtaaaagtggcttattgattatgctgattgtttgtagccaccttcctccatgtggggaagagtttttattttgttccctaagatccccagcaccataacagtacttgcacacagtagagacccaactgcatttattgaaaaataatgcagaattcatcttggaaacatccttccctagactctgaggcctgagacaaactttcccatgaagcatgcggatggggtaggggcacagcagcgtggccagtgccaagaaagctggattccacacccacttccttctgctcagccttgggcaaggcccctccctgctgtgagccttggttgccttctccacaggctccttctctcttgggcctgagcagggaagcactgccgattccctttcccttgccttggctctgagctccccaaggtggccagcggctggtgggtgggtttccccagaagtctgcgcagagtccctctggcttgccttgtgggagaccctcagcaggcccaactgcccaagatgctgcaggaacagcgggtcagggatcctcagggctgagctgccaggatcccaggccctcccacagtccctcaatggggaggcctcaggggcctctccttcatctcagggaggctctgagggctgggccaggcagtccagtgtgtctagagctctccttgccccccttccaccccagcaccccctcaccccagcattagcatcctcttggccacctggggtgataggaagaggcctggactgcaggtccaaggacctggatctgcgtctctgtgcatcccctctagcccaaggcgctctgccaccatggccacccacagtttgacctcccacccagccttggtagcttcaacctggactctggccaggcttactgggggctgagcctctgagtggggtatggagactgcacaggcctgagcctgttctgtaaccacaggaaggatagctcctgctggtatgcagaacccgatgtcaaggctggaagccatcagcaaacccggcgccttctggaaagcccttttcagtctgcagatcctgacccctactctgttttgttcgatcccctagagaggtccctccacctgcaccctttgccttcgcttcctttgtcctcagtgagtgcaaacccaggcctgccctgcaccgacccgtttctctctgcttggctactctccctcttgactgacgtcaggccccctgtcagacccctcattcatgctgcctggcacccaaatgtgtcttggggcctgggtagctgtggggcaggggcttcacactccatctgccaaccgggtgttcagaagccatgctgacctcctgccccaggccctccttggacatagcctgggcaggcagccctcacagctacctgatcatctagggcagcaacccagagcccctgagccagtgttcatggcttcctcctcctctggggtgactccacccctgtctcatcctccccagtcagtaccttctccctgagctggaggctctcccctgcctgcccagcatcccttcagtagccttctccccctggcatgtgtgcatggaggctctgaactgtcctcctcgtgtgtgcatggaggctctgaaatgaccatctgtctagtgggcctgatggacacttacagtctgctgtggtgtgtgctagagcacaagcttgtctgctcacttccctttctggaccctgagccccaagcccctgccctggctcacgcccctaccttgactactcttgaacgatcttccctagaagcaggggcctaggtctccgcctgctgtggctccaaactgggggctctagaggcaggaccctgtctcctatttcttctcttcctctgagcctgggaacctgaggacaaggcctgggtcactcagacttacgtcctccttcctctctgcctgccccacagcactgctgcgcgcctccccttcagcctactggctcccactgggccctccgcctcagctccttctcccgcaccggcaatgggtttctccttcctgttcccttcgggtgcccacactcacgtctacgatgaggaagtcgagccagcaccaggcattggtgaagtacttcttgaagccgtaggccacccacttgagcagcatctccagcacgaagacatatgtgaacatcttgtcggcatactcaagcagaaccttgatggtcttccgctcctctaggtagatgtcctcgaaggcctgcagacaaggccagacaaggtggacatgaagcctggaccactgccgattccaccctgcaccaggcaccgtttctttccattttttctttttttttctttttgagacagtcttgctctgttgcccaggctggagtgcagtggtgcaatcttggctcactgcaacctccgcctcccgggttcaagtgattctcctgcttcagcctcctgagtagctgggattatagatgcctgccgccacaccagctaattttttgtatttttagtagggacggggtttcaccatgttggtcaggctggtctcgagctcctgaccttgtgatccgcccaccttggcctcctaaagtgttgggattacaggcatgagccactgtgcctggcctaggcaccgtttctgacaacacctcccttccggggagagcagaaacaggaactagatgagaatgccttccaagtggggcctgtgccacgggcaggccatgagatggccttaagtggtagatggataataaggtagagtgaatggtgtgaccccctctcccttagcaatgaagatcaagtctgagttttgggctaggcctttctaaaacttgccattttaacaaggagagagggtatgcaggctcagctcacagctttctgctggaaacaacataaaatatttttgttttcactccattttgctttagctttgtttactttatatggttacttgctttttgtgggaaaaatattggtttccaattaataataatgattaagttacactttacacaacatttatttaaataagcaaaaaccagtgagagttgatgtaaagctgaatgttaaagaaactatattaaaagtcatttgtagatgtggtgtttaggaacaacaggtgtagataaagtcaaatgtcctgcaattctcaggctctaggagtcaaagttttccaaatcctaggagttgtaagtctttctccacctcctcatttctgcctcaactcaaattcctgagctaacagagaaactccagtggctcccagatggcttctacctccagcctactgatttgttcctgtttctctctctgtccagactgtgctatgaggctcctgtctaggcaactgaacacgtcactagggctctgggggagctgcctccacctgccactcctgggccttcctgtccgacttcagggcctctgtgagcgacagtgacccaagagaccagcgctgttggcactactgaggcatacatatggcccactgaggcactgtagatggcacaacaggataattcaggtcccaaaatggattttgggagttgttcaagataaaaaaaaagtaggtgtattgtatttttttctgaatataaaaatgggtgcatcttataaaaattaaataatatggaaattataaaaaagaaagtaaaaggcatctctaatttcatgacaccaaagtaaccactgctaacatttaggtgagtattatttttgacagtgtgtatgtgtgtgcacatacacacaatcaccacaattttatgagacacactaaatatttgccttgaaattactttctccattaaacaatatgttgtgaacagttatccactcaataatatgaatacatgcaataatatctatcactattttaaaaggctgcatgatatttcattatttgcatacgctgctatttatttagccaataaccttattaataatgcacatttcggttctttacagtttatccctagtggaaataaagttgcagtggacaggggattgttgaggataaattgggttgccagggcaaaggtgtgcttttggtacagactgggaatggacccctccgaagggaacaccaattgacactccatctccggggcaggaagggggctcttctctaccaccccaccgacattgctgtcatttctcctttttcacttttcccagcctaatgaaagaaacttgtattttgttacattttcatttattttattaggagtgatgctgacatcttttctttggatatttgccatgttccttttgggaattacctgttcatatcctttgcctatttttgtacttgagtgtctggtttatttggggacattaactctttggtaacaccaacctggtttgtgacaccaacctgcctttaaatctcacttgcttttgtttaccataccgaagttccatgtacttcattttcaattattatatcattttatatgattatatcatttattataattttcatttagtaaaatttttgatgttacattaagaaagcgcttatctattctgaggctaggaaaaaatgagcttcttaaaacaatttttgtggtttcattgttttacattacaattttaaaaattaaatatagtttggtaaggagtaaatatccattttaatgctttttttcagaatgtagctcatcaaatgccccaacactttattaaataatccacttaaaatccactgattaaaagtcaactttatcatatagtacatttctttatttacttaaatctacttcagatctgtttatgtagttctactgttctctgtctattcctgaattagtatcacatgaatttccctggacatttaaataattttcaagataaactttaccaatgtttcgtcatatttcctcagaaatgttgaaagcttgttatcgcattgaatctattaattactttaggaactaatatgaagtcttcctacccaagatgaaggtatgtttatctatttgttctgttttatactgcttggcaaagttttacagttttcttcatgaatctcttatgcattcattattatatttattcccagttattttatgcttgcagtgcttggcatgtaagaaatatttgagagatgttacttgtgactaaacggtttctcttaggataatacaataatagcaacaattctttgcatatttatttcataactggccatataatgttttaaaaataggtttaaattcttttctaggcaatcatattatctataaataatgacatatttctatcatttttaactcttgcttttatacttgactggattaacttcaattattttatttcccaacttttatatcatgtgttcaattttcttaattaattacactggctagtaattcaagactattattaaataatgagcaatagctaaaaaggcaaatcatccttttcttattcttcactttaattaaaacgtttcaagtggttttaccaccaatgatgatataagttaatttgagagtcagttttttactaaattaagaaaatatattttctttcttttttttttttgtcctttggattcagtagtagaaaacgtattttatttctattcttaccagagttctgaaaatcaggcattcactgaaataattatatggttttttatctttgtcctattaatacaaatagttttcctaatatggtactattttcacattttaggatatgacacatttgtcatatgatgtactcaatcttttaaatatatttctagatcctatctgcatgtattttgtttaagatttttgcatcagtattcagaagtatggagtatgaagcataaaaactggcctaggttttccttttggtatacttgaggttttaaaaatcagcactatttagtttttaaaaaaataatttctaggccaggcgcggtggctcacatctgtaatcccagcactttgggaggccgaggcaggcggatcacctgaggtcgggagttcgagagcagcctgacaaacatggagaaaccccatctctactaaaaatacaaaattaaccaggcatggtggcgcatgcctgtaatcccagctactcaagaggctgaggcaggagaatccttgaacccgggaggcggaggttgcggtgagctgagatcatgccactgcagtccagcctgggcaacaacaagagcaaaactccgtctcaaaaacgaacaaacatacacacaaacacacaccaaaaacaatttctagactttctatcttttttcatgcactagagtactttaaatagcattggaattattttcttccttgagaatgtgaaagatctgtttttggggatgtgagaaattagattagctagtggttatcaatttggttgccttaaattttcaaggaatcagctttggaattttatatcaattttactatttattttctaattcattaatatacatttttattactgcagatcatatggggcaaagaaaaaaaggttattttattaattacttgcctaggtttctttaagattattttgttatatttttaatttcttgaattaaataatttatgttctttctatttaataataaaagtatttaagtaatgaattttccttttattacagctttggctgtattccacatgcagtattctcaatactgttattttccagtttttttctaccattcacagctttttctctacctctacacttttcttatttttccagatctcacgtggacagaattaatggaatcacaatctttgatttatagcacactatcatcaccattggtgcatgagtggccttcttttgttaattagttaattaatcaattgaacccccctaaactaccaccaaactattttctgtttgatccaaggtttacttaagaatgacttttacattttaggtggtttttattttttatttttttatttttttgagatagagtctcgctgtcgcccaggctggagtgcagtggcgcgatctcggctcactgcaagctccgcctcccaggttcacgccattctcctgcctcagcctccggagtagctgggactacaggcgcccgccaccaagccccgctaattctttgtatttttagtagagacggggtttcaccgtgttagccaggatggtctcgatctcctgacctcgtgatccacccgtctcggcctcccaaagtgctgggattccaggcgtgagccaccgcgcccggccaggtgtttgtttttatctattttttccatttctagcactttccatatctgtaaaataggattaataataatacctatctcatagggttattgtgagaattaaatgaattaatgcttataaaatgcttaaaacagtatctggaatatagctagtgctatttaagagttagctattgtctttattattattatgttaggtcaaatttattttatatatatatatgtatttagatctctcattgtcttgttctttccacttgaatgtcaagaactaatagaaatatggcaaagtttcccagtactagtgcactgttgtcactttttcctgtttgtttttttctccagtggttttggttttatatattgaagtgctatgcaatcccaagcaaatgtatacataatatttatacatataataatatataaatatgcacttatataggtgcatattatatattataatatatacttatatttatatataggtttatataattgtatataattatataaatacatatatgtataattatataaatatatatttttataaagatatattcatatgtgaatatatttatatggattatatttatatatttaatatacaaatatattttttatatttatatatttaatatacaaatacattttatatatttatatatttgtacatatatatttatatactttgtataatctatatttatgtattttgtataaatctatattcttttatagattttatatattatatttatgtgtatgaatatatatgtattttatacacacacacatacacacacatttttttttctttttttgagacagggttttgctctgtcacccaggctggaatgcagtggcatgttcatggctcactgcagctttcacctcctgggctcaatcaatcctcccacctcagcctcctgagaaactgggactacagacatgtgccatcatgtttggctaatttttcttttttgtagagatgggggtctcactatgttgcctaggctggtcttgaattcctggcctcaagcgatcctcctgtctcagcctcccaaagtgttaggattataggcatgagccactgcacccagccaatcgttatatttttattataggttggaccctctttctctcatctcaagcttttaacattgaattcaacaaacaaaaagcaccctgaatttgttgtcataatttgcatttgcctgatctactttattagttcactatatatataatatatacacatgtaatatataatatacacacatatattttatatatatatatatatttgtgtgtgtgtgtgtatatatatacatatatatatatatatattttagacaaggtcttgctcggtcacccaggctggaaggcattggtgtgaacagggctcactgcagccttgacctctcaggctcaagcaatcctctcccctcagcctcctgagtagctgggaccacaggcatatgccaccatgcccagctaatttttaaaaatctttttgtagaggtggggtcttactatgttgcttaggctggtcttgaactcctgggctcaagccaccctcctgccttagcctcccaaagtgctgaaattacaggcgcgagccaccatgcctggtggcttttaatatttctgagtcgcattgttttaggtttgtcatttgaaagcacatggctgaaggtttttttttttgatccatcctgagtcctttccttttaaaagatgaattttatccagttacatttattattaaaacatgtgtttgatcttgcctctattatattattttgttttctgattttgttttcttgttgcttctttttccttctaccttttgctgtgagatctctgttttttctttttttaaaaaaaattttccctcagcaatttggaaaggatatagtttgctttctgttaaacaagtttacaactttaaataacacactcagatttctctttttctcaatatatcattgacgtggttttttaacaacagagcttggctgtctaccctgattagattcaccagatgcttgccaaaactcctcctcacttatgccaagctgagctttccctccacagcccagacgaaatggctctggctgcccttgtttgtggctgtttaaaaacaaaactagttaacatattgtcaaaccatctttctctgaagcctacagagatttggctctagctgccaatggtaaaacagcaggcaggctgcaagtcatggctccaggcccattctggaacagaggcgaggcagcatcgggtggggtgggaggcccagaggtttaaaaatgacagccacagtgcctccccatggtctaaccccacaggaggaggcagcatggaatggaggcacatagccttggatcaaagtgccctttctctcactctgcagtctaaagcattctctgttagttgctcatctatggggttctcacctccccagcaatacaggctcttactttccctggtccagcaaagtttccatgtcttttttttttttttcagacagagtctcactgtatcccccaggctggagtatagtggtgtgacctcggctcactgcaacctctgcctcccgagttcaagtaattctcatgcctcaacctcccaagtagcttggattacaggtgagtgccaccacactcagcaaattgttgtatttttagtagagatgggcttttgccatgttggccaggctggtctcgaactcctgacctcaggtgatccgcctgcctcggcctcccaaagtgctgggattacaggtgtgagccactgtgcccggccatcttctgccttcttaatcacccctctccctgcttcaccagcaccttccagaaccccctccagggctgttccatctcttcctagaagtgcttggagagattagagcagcatgcctgggagccagatggggcaaccctggaggtcctcactgctcctcctggcttcaacacctccctattctccacagtccagctctatctgcttcctctagggagactaccctgattgctccacccactctggcctcccatcaccctgattgggtgttcctgaggccagggctggggcctcctcctgtagctcccacatggctgaatacatagagctagatacaaggagggtttttagaagactgactgaacaaatgagaagtcaaggcaaaggactctggaatctgactgcttgggttcaaatgccagatctgtggttcctgagtggtgggaccttgagcaagttacttaatgcttctacaaagagttgtcatggggattacgcatcatcatgtgtgaactatagggcgcagcctccagcctgaagacatagactcagtggagccagcactgtactgtgagccagcgtggttaactgcactgtgacagcttgacagaacactgatgctgtgtgcaggtgggtgtgtcaccagagctctggtgtaggaggctggtgatctggggcaaatcatttcccttttgtggaacaaagacaaaggcctggacacatgccctctgtgagcccttcctgctctggcctccatacgtgccgtggggttgagagtttgtgagctgttccctgctctgggggtctggagagcacattttcagcagaggctctgccccagtttctgacctgactttccagctggagacctcctttccctgccctcccctcctcctccagccgtccctgccacaaccctgcatccccaggagggtaccagcgctccactgctgagtaggatcatgaagatgatgaatgtctcgaaccagctgtgctccacgatgtggtagcaggtcttgcgcaaccgccaccagaccttccctggggcctgtgtggtgtccaccgcacagcagggacagcgccggacacagcctatgggagagagtgagggtcaggcccacctcagggcctgtgaatgcccacatctaatggcagaaggttggatggttgaagagatgactgagagaaagagctacgatgatgggggtggcgaacagggcaatatggtgagcagggccgtgtgagcgagggccgtgggcaccacccgtgggggccacacgctctgcgggcactctttgaggaggatggatggactgagcacccagcgagtgggtgaacagcctggcaggtctgggcagggacaaggctgggctgggataggttccagcttgtccgctgctcatctgggaaactgtccccctgggaaaatggtaggaactcctgggcattccctgggtcttctccatgtttgtagtttctgagccttgggaagggcagatccctcaatgagagcccccatggatgtgtcacatggagggcaaactctcattttgtttttctctttttttgagatgtttcactcttgttgcccagtgtggagtgcaatggtgcaatcttggctcactgcaacctccgcctcccgggttcaagagattctcctgcctcagcctcctgagtagctgggattacaggtgcctgccagcgcgcccaactaattttttgtgtttttagtagagatggggtttcaccatgttggccaggctggttttgaactcctgacctctggtgatccacctgccttagcctcacaaagtggggattacaggtgtgagccaccgtgccgggccaagcttattttatccccagctcattttatccccagctatcctccaaatataccaccaatccataaaagctatagatgccaatcaacatggccacatgtcatccctgcctcaaggatttacagagggcctactatgtgtcaggcaccgtgccagggcctggtggtacaggagcgaattagacccagaccctactgctgttgggcatacagtggtgccaacacaccacaaatacagtgtctccagtccttggtgcagctgtccagcccagcactccatgggcagacacgtcaggcagatggaggaacccccagggtcacagaggaatggaggaggtgggcagatatctaaggcagggtgttggtgccacgtggccctgggctccaaggagctgctggtcctcctgtcccctctgggtggaactgaggctagggcagagggctgcccgggccattaccttcagtgaagcagtcctctgggtccttgacatcctggccgaggtcagggatctgctccaggagctcagcggtgttggtcatgtctgctgtgctgccctcggagcaactgtcctctggggtctatggacaggggtgtgggacagggtgggaaagggtgtgagtgtgggctgagtagcagcctttggcctcgagcccagagtctgcaggagcttagggctccctgaagggaggcagcatcttcatgacgcaccctgggacctgcacagagccacttttgcctgtcagggctgggccaaggctggacctcggggttcccgggtctgtgattctggtctgctggagtctaaggctggggtgtgggggctgtgaaagagctctgggaagccactggggatggggactgcatctagctgggagcaaaacggacatggggtagcaacctggacacacagtgggacatggacacatcgtggtggtgtggcacacacagtggaaacaggcatgtcacatccagaacagagtcagaaccaggatcccgggcaacacacaggcagcaaggtcagaccgcagagaacaggccagcaaccccacccacacattttgcgcagttcccgtgggttctggtgtgctggacagagcccggagactgagaaggtgatggagccctccacttcctgtccttgcaagtctgctgccctgacctcaataacttgattatagggaggctacagagaggcatgtgcatgcaggtgtgcccttgtgagtgtctgtgtgtgtcacttgtgggtgtgggtgtaaaggggtgttacaggggccactgtgggtaccctgcccaattccactacataagaccactgcacccattcccagccacttgaatgctagctgcttagctggccctcctccagaaaatcatcttcagctgggggactgccgtcccaaggggtggccggtgcccagcagccactgatacaagaatacagaaggccagcccctagccttgagttggggcaatgctgtggtgcaattcatgccccagagctctacttgggacaggatgaggctgactccagctggaaagcctttccgtagcttccttctttgcttcatcctgtttctcttactttctcctgagaacacccctcaacaagtcatttgcataggaatccctctgcttctagggaacggtacgtcaggggaggagtgtcagtgaaggaagaaaatccatcgtttgcatcaggtcaggtccaaagaccccatctccgctgcccccgcctcacatcatctcaggctcaggctccatttagagaggggcttgtctgaattcttgggcatggctatgctcctacagctgccttctctcttctcttttcctttgatgaatcaatctgctgatgtctcaggggcttcttttccatttttgagatctgtgatgggaaaggggtggattctggagggaaaacagagcctactgctcagagaaggtggatccttggccagagaggtgaggctcagtcttttgtggtcccccatggcattgagggttccttcccctctcctcctagctcagctgggggatgaaaggagttgggtgatgaaaggggcaggccagaggagagcagcatgcttattttttctttccaaacactggagccgtctgaagtccatggggctgtcatgtgagaggacacgttctcaggtcctactgcaggtgagacgagggagtccctttcccgggaaaactccagcctgtttctccttatataggctcccccatgaactgatttgaagaaaggaagacttataaaattcattcaaaggttagcatccgtgtgagagagccacttctctcccatggcattttgcctctctcctgtgtcttcctgtccccacatgccttcacagctcagaccatcaggggaagaaccgtgatctgcacagtcaggaagatgactccagtaggcccttgtgctccaaaaactgaccatgcttgcaaagctcacatgggcccatctcacaaaagaggagaaggcacaagtgctggacggagtgaggtcaagctgcaggacagtggccaccaagcactctgaacacgtgccctccaccttccgtgggctagatgtgagtgaggctgggcggcttagtcagcaatgccacaagccttttgctcaggggttgcgaactccaatgcttacagaatcaggcgggtaacctgttcaccatgttggccaggctgatctcgaactcctgacctcaagtgatccacctgcctcggcctcccaaagtattaaaattacaggcgtgagccaccgtgcccagcctcctgaagtcttctttggatggggagattcacaggacaaacatttgccaaacaggaccaaaacacagggatggagtatgtggagagggtgaacacatggaggtagtgggttagtcctgcatcagagtttgggaccagaatttccagaatttcccattggccctgggccctgtaccgtctctcccctgtcaggacagggatgcccaccctcccctctgcagactggtcttccacgctgcctgtgacagtggctgtggctcccaacagcaaatgcaggcatgcacctctcacagcctggctctgacccaagcagcggcgcccagctggcttcagggacaaaggcatgcattacctcaccgcaccctggggcctggggttccgctttccactgctgccgccagtcggcctgagatgcactggcctcggcctcagaggaggcagtcgctgacacctggctccaggtcctggaatccggaggggcctctgggccaccggacacaggctgggattcctgctgaaaagaccccagcctatgagctgagtccacacacccagccagagggtctccagggccctgaccctgggggtttcagaccctgcccatgcatctggggcattgcctccagctgtcttcatggggcctccatctcactgaagactcctccctcaaggggcctgagcaggcaggtgggaggctcctggtaggtccaagcaaagggcctagagacaggaagcccctggccggcctggcataactccccctccccagactccctggaagggtgcagctgggccacgatgcccagctcacaaatgctggccactgtacttaggaaggtcacactgacttccctcatgaatccctgtggcactcccggcttgcgtgcgcgcacgcgcgcgcacacacacacacacacccccacacacaccacacacacccaggagccagagtcaatgggctcaagagaaggaacagagaagggaaatgagagacagccggaattcccctcctgtgctggagatcattggaaactgtggtcctggcaacaccaacactccctctccctgagcagacattgccactgccccgcaacctgacttgaaagggtggcctctgggaccacagggaggcaggaggatgtgaaaccaagcccagagccttagatcaagttccacacatggggagcagctgctctccacagccaggcccagccagtgcaggcccagaggaagcagccaagatgggcctgactcaacagggagaacactcctgggggcttgacctaaagccctgagaagaagccatctgagcctggctcaggccaagggagaacggaggggaggggaggggtgggccctgcctgctttgtgcagactctggtcccaagtgttaaaaataacaggttgcgagataagatagtgctgtccctgacacctcagtcttagggatgcttatttttaaatctcagaatgagccctgggtgtgggaggaggggaaggggcagtctggaggtcagaaaaccatacttctctttcgccaagacactctaccttgccagtcctggaggggggacaatggtcagtgtgggaactgggggctagaggctctgttctaaactcatgaggaacacccagcaagtctctcttgccatgcctccgtttccctgtctgtacaatgagctccccatgcccagccagggcatgagtggtggatagcagcccctccccaggtcagcttctggactgagttaggaagggagggttgagggctggtctcagcacccctctgagaggctggctgttgtggggagggcctgccttctacccctacccactgccaaggcagtctgggaggggaagctgctttgagagaggctgggtggcccggacagcagagctctgggccctgtatatgtaggtgccttatacatgcaggggtgagggcccacctgcttgctggactcctcctccgtgcccaggctgttctcctcatcttcttcttggtcatctgtgtctgactcggccacagcgatgggcacacacacgggctctggatccccgggggtgccctggcctggttgctcgccttcctcaaaccgtgtttccttgcgggtgggaggcaccttctccgtctctgggggtggcggggagtagggggtggcaatgcagctgggcagctggccctgggcggcaagggctgcgggcttctgaggccgctgccgcaggagaccacagcagaaatcccaggtggtccgcttgacaaagcgcaggcccctctggatgcgggccagggccagctggaggttgttcatctctctgtcctcatcaggggctgtgaggttgtctgcactgaaggagctgagcagcaaggccaggaagagattcaggacctgtcgagataatgggtcaggctcaccaaggcactgcaccatgccaagccatccagtcccagttctatgatggggaaactgaggcccagagacctttaagactgcctgtgacaaacagctccgaggcttgaatccagggccctgagccctcatcctaacccctcattttattgaatgtggaaggtttggctataaaagaaaatacaaatttgaatccctctttccaagggcccagacacagtctgaattgaggatgtcgtgtcctggctcaggttcaatgggagaactatgcgtgcattcagtgtcaaagcgaggggctagcacaaagtcacacacattgagccctgtcttggcaccagcggcttctacatgcaagccttcttctccctttacctcttcctgctgccttaggagtagtgaggggcagtggggtcaggatgggcacaggtctccttcctgggaagtgtgagtccagggacaagacagaatcccaccgagaagccacacagagcttttgggactttgttggaaagaggaggagcagtgacctgcctctgagttccctattgaagccagcttggtgctcagaggcctggggctgctgctgtagggcacacactacctgaggcccaggtctgccacactttccaggtgagggacgctgggacagggcagagaaaggtgcaatagctggaaaagaggtcaggaaggcacaggcagccttcaggcatttggactaatcatggggtcaggacatggagagctgaccatgtctaggctgtgaggggtgctaggaagggtgctgtgtgaaggtcaaggcctgctattctgcagggagccgggggaggtggcagtgtcggaggttccacagggcgcagtattttgttgaggtctatcatcagggcttagggacttgagacttcttaagggggtttgcataaccctctgcctttggatggttctggagaattgcttgtcgttaagccctcctgcaagtgtgaagctttagcttttgtttaaaaagaaggcctttgatgtgtgacaagcggctgggcttgtgtccatttcccagtcacatggagggtcagttaagctgacggtgggtcgattcccacatgcatgggtcagactggcccatggctcaccaggccgccaggccaccatgggcttggtgtctcctccctcccagcacctttatagcagggtggtgtgtgagggtgggtgcacagttctttttggaaatccactctgagactctgttccggtttctcaagagcctctaaaacacacctctaccagggaccccatacctatcagcaagctgggaatgagaattctgataaaagcggcctcagaaacatgcctttggcttaaaagtaatacatattcatgtggaatatgtacagaaggtgaagaggtagcctctcccgtactatctctacggagagatgatcacttttgacacttggcactaggggtaaggcatgtgataccattctgagctgctatctacaccgacctcgggcctggtccctggcctttgtccacaaggacccaggcatggccacctccattcccaggaaggatgcccactggatccttcccccacagcctcactcacaccaggccctgcatcccccaacctccaggagtcctgggcctaggctgggagtagggcgggtggtgtgggtacctgggcagccatgcccacccacagagtctagggccctccctgtcgctggcttcagaagttcagcttcttccagtgctttccccatcaatcgtgctgctgctgctcccagccctgcctgatcatcacttcccatttcaatggcaatcttgcttcctcccacgcctggcagcggcccaattccttaggcggctggggagggggctgtgtgggctggcattagctccctcctccagcagcctctaattttctcatccccaggcagatctgctgggaaatcgcagggctccgtgtgtgaggggtggctcagcctggccctgggctgagtgcttggcaattctcattctccccagaatagacagtctggtaggccctggggttgggatgggctgagcaacccttcaccccaagggatagctagtttggggggacataagggggagttgggggccagccaaagagcagggttctagtggcactatgcactgatgccctggctcctctctctctgggctctgcactcctctggcctctgggctcatgggctggtggcagactgctcccagattggcctgtcctgtcctggcctggataaggcacatgggagaagagagcagacaggtttggggaaaggctctggaatctatagcccatagtacttgccccacagcagcctgaaaaagtgaatgtaaaacctctctgtgagctgatgtgactgcactgcccacgacagagacatacagctacaggtgcgagccagacaatgcaggtatgcttcttgagcatgtgtgggccaactgtgtacccagcaaggtggcttcatgtccacagcggacacggattgctgcctgaaccactgacgaccccaaccttccctcttcctaaggtgccttctctggtatttaaattttggcttttctcagttccagaattccccacattggaaagacacaagacgagatgcacctgcccaaggacagacaggtacccacaggagcaaaggtgtgggcccctcatgatgggacagcagagactcctaccacgctactcagggtgacatataaagctcctatgggccccaccttacctggaccaccacctgtctgcacctgtgctttgctcatcctgttccttccctcttcagcattgcctgtttatcaggtcagctccaaaatctcttccagaaagatttccttgattttcctagctgaatgggaacagtaccatggtctcctccttaatggttctgatcactctgactagtctgagagttatttcaggcctgtttgaactctctacctccccaataatctcttaagctggtgaatgatgtcagggctggcgctagacctcatttgcctctgtattcccaacagcatgtggcacaatgttttccatgcaataagggcttagaaaatgtttaagataaattgaaaaaacatgtgataattcattgatagtgtatgacagtaaaataatgggtagatgaacagataagtaaatgaatgaaaacagaatgagtaaataatgaataaataggtaagtaagtgggtaaatgaatgaatgagcaaaatgcagtgaagaggccaggcacagtggctcacacctgtaatcccggcactttgggaggccgaggtggcggatcacctgagctcaggagtttgagaccagaccggccaacatggtgaaaccccgtctctactaaaaatacaaaaaattagtcaggcgtggtacatgcctgtgatcccagctactagggaggctgaggcagaagaatcacttgaacctgtgaggcagaggttgcagtgagtcgaaatggcgccattgcactctagcctgggcgacaagagtgaaactcagtctcaaaaaaaaaaaaaatgcggtgagtgagtgaatggatggatgggtcaatgagtgagtaagtagacaactggatagatagatgagtagatagatggaattggtgaatgagtgaatggtgagttgatagatgggaggtggatgaatgagtagaggagtgaatggttgggtgagtggacagatggttgatggatgaagggagggatggatggttgtgtaagtgaatgggtgggtacatagatgaatgggcatatggatgcataaatgtgtgaataggggttgatgaataggtgactgataagcagattaatgaaaggatgagtgaatgagtaaaagtgggttggtggatgaatgacaaggtgaatgagtggataaatggatgggtggtttggtaactggggaagaatctactgatccttctgattgctggagtggtgaacagatagattggtgtgttcattggtgggtgggtgattgataagtggatgatcaatagatagatggctgtatgagcatataggtgcaagaataaatgggtacattgaatagatggtttgttgataagtacatagatggatgggtaagtgagtgcatggggggggtaggtgaaataaatgagtgagtagttagatggaaaggtgggtaaatgaatagatggatggacggatgggtagatggattgatagaagggtaagtaaatggataattggatgggtgggtagctgggtagatgagtggatggtgtgtgtgtggcccttggccaacttaccacaaggttgccaatgaccataacaagcaagaagaccagcaggcataatgactgccccgacacctccatgcagtcccacatggtctcgatccactctccacagaggatgcggaagatgatgaggaaggcatgaaagaagtccatcatgtgccagcgaggcagcaggcctgagtcgctgtccctcagctccgagtagttcttgccaaagagctgcatgcccaccacagcaaagatgaacacgatgatggctagcaccagtgtcaggttccccagtgcccccactgagttcccgatgatcttgatgagtgtgttcagggtgggccatgatttggccagcttgaagacccgcagctggggaaggaggaagaggaggggaccttgtgaagggctctggctcctgctgcccatgggcaccctcactctctctagctcctgcctgaaagcccaaggagcccttggagggcactgacacctattccccccccgccatttctcccagagcacccactactgtttctctccacagcctgagggcagcttcactgggcactgctctgggagtcaggtcaacagctccagcctcaccttcccaactcagcccttctctttgtccccacaccagcctcctctctgccttggcctcacttccaggaactgcccactagattctcccaacagggaatgtccttgctctttcacacctgtcctcatcaggtatcctttgggacagctcaaaccatctctgactggtcacctctgcctcccagtcatcacagagaaaggggggaaggtgcttaacacttactgaatgtctacgtgccaggccttgtgcttagaatggatgaactcaatcagaactcccaataaccacatgaggttggcaccgctattacctcatttgacagaagaagctgccaaccctcacaggtggagtaacttgtctaagtcccttggttcatagcagctgagtcaggattagaacccacggccttggctttccctcctgcccccaccgtcctgccttcctacacactcccccgaccccactcccatccactgtatgtgcagcaacccacagtgctcaggacctcctccaggaagccttccctgactatacctcccaccccatgtctggacctctcaagcatttcaagctccaagtgtggtccacagaccagcagctttgacatcacctcagaccgactgaatcagcatctgcattttaacaggatccccaggtgatttgtgtgtgcattaatattttaaagatgctgattcagaaagcagcaggcagaacctcggatgagcagttagcagcccagctccctctgttatctgccatgtggctgtgggaaattcgtctcatctctctgagtctcctcatctgtgaaatggaaatgtagtaataccagccccactcctggatcctgtgagggctaaagggttcactgtggaccacaaagggctttgcaaatcatcctgatggccaccacaattgctcctctggaagaatgtctcctgcctttcctgcctctgtaccccctacctcaccagcactgggccaggcatccaggggtaccaagcaaatggctgttgggtgaaggcatgacagatcaaagtagggatgaccaagtgatgacctcagattgggttgtgccgagccttccacaccccccaccatcccccatgcagtgggtccagccaggtaccaggcggaaggagcgcagcaccgacaagttgctcatgcgggacaggcccagctccatgaggctaaggatgacgatgatgctgtcgaagatgttccagccctgttggaagtagtagtaggggtcgagggcaatgatcttgaaggtcatctctgctgtgaaaatccctgtgaagacctgaggagggagcaggaattgtttgggatggaaagactccctggccagcaggggcacctgcctcttgactcttgctgtggcaggggctccctccagggctgccagctctgattgcgcccaggctcccagtaggggtttgcttggctgtggcccagccccttggggacagctctcttctccagcctgctctcccagcccttgcagctgctcaccaagcataccaggcacaccagcttggccttcaggaatggcctgggcccttcgcaggctccacagagactcacagctctagggggcacctgcgatggacagtgacatgacctcgcactagacttctgatccgtgtgtccacaggaagggctttcacccatcacatgccaaatccatgcatcaacacgatgctcatggctcccctgacccagggcctctgtccttgctgttcctgctcctcaggaggcccttcctcctcatctacctgctggaccctgcccactgtgataatcagcagccattgcttcctgagggctacgtgccaagtgctggtcacaacactttgcacatgttgtttcttttgattcatccaacaaccccatgaggaagtatcattgcctgcagtttataggtaaggaaactgaggcactgagaggttaagtaacttgtctggggtcatgtagctattaagtttgagaatgaggagaggaaactagtgctgctcttcagaatttagggaaacttcctctctcttctaggaacattcctgagtgggcagaggctgagctctgcccggttcattgacttacgcgtcctgagctgcccagccttggctggcagaacctgtggtcaaggatcccatggtgcagtggaccagaaacctgtgccagctgccctgcagtgtgccaattgatgggagcctggttcccagaggagagaatgttctgtgacggtgtggatggcaggaagtcagggtcctgtacgcagggcctcttgaccatgctgaggagttggggggctgtcctgagggcagtgaggaggcactcagggtcttttggaggggagggctaaagccagagggccagagtacccctgagaacagtgtcaggcctgcagcagttgtgaggaggtgggggtcaaagacgggcatggctgaggcacctcgctggggttggcaatcaggtggggaggtcactctggtctgggcacccgccctgacggggctctgtgctaggagaggcatttgctggtcaccccagtgccatcctctcaccatcagctcagaagaggccctgtggaggtgggctggagggcagcgggatgctgttggctcagagagaggcaccgggagggcaggtgggtgggctcctcagcactgccacacagggcaccacccaccagcccagccctcctgacttcaggggtccctttagtgcttgtgcccagagggaactgttcctccctcagccgggtcttgggaaagggagggaccctgaaatcctccagcctcagtttgcattcctcacacgtagagagacagccttgagacctgcttctctccccagcacccaaacctgctttcataacttttccaacccccagccccattgcctgttgctctcctgttccagccacgcctgttccttgctgttccctcctcggggcctttgcacttgctgctgctccctttccccgggtcatgcctttccccagccgcataactcactcccttcagagccacctgatccatgggcgtcctggtaactttaaatgtgcctccctcccaccacattccttatccctcatccttgcttcgtttccctctgcttcacgccaccatctaacaactatttgtttattgagcctcttctgtttagaagataagctgtgtgatggcagggacctttccctactgtacctggaatggtaaccagcccataggtcgtcctctagtatctgttgaatagatgtacaaatgtttgagcctttggccttccgtgcgccatatcctgcctgttccgtgctgctctgcttgacttccaggagccttccctacccagcctcagacacacacagctgtgcttagagccctcactcagcagcacagcctgcacagctttgctgagagctcctacaggtggggcccgggtagcgcctcacttggacccccacttttggtcttccccagcactgccggggtgcaccagggtgggtctggcacccatgagtgccgacgctcatttctagagaatggagctcaggaaaagccctgcacctcactttgcgcaggctctcagctgttttggtggtgagatggcagttatcaggtggagctaggactcaggaaaaaagagacaggagaggctcgtggggaatgcccttcggggaaatgataaaagaattttcagggatcaacagcatcacctggaagctctttggaaatgcagaaacttgcaaggccccagacctgctgaattagaatctacattttgaccaggttcctgggattcgaacttcaagtgctgtttttgaccatgagctctgaaacttggtgcactctgtaatcacctagggagctttaaaaatatggatgcctgggtcgcatccaagagattctagttacattggactggagtggagcccaggtgtggggatttaaaaaaaaaaaaaaaacccaacaacttcccaggtgactctaatgtgcagctaagcttgagaagtacatacattttggtaacagacctcttccttccacaggctcatgccaggctttctaaggccatgcgatcaaagcttcatggtttaagatgtgcagagaattgtggccaggcccgggttccagagcaggggctgcctctgtgtgatcttgggccagtttcttcatctctctgagccttgagtgtcctcatatataaaatggggataataataactccataggaggtttctaggagttacagctaatggctgtaaagtggatactctctatgacagggcgattattgttactgtcagcagcatttattatgattgctgagagtggccaagagctccagacccaggcaggggctgccttcagatataaacaactctgcatgttttataggctcactgggatctggcagatagaggctctgagcatggtgacccacttcccctaactcctggcaggaggttcactgagcaatgagtgcaaatggccgctttccaggaattgggggaacttatggggaaccccaaattctctttgaccttggcatatgactttaatgggaccatactccatgcactgcaaacctgtatttaaaacataataccttatgaacatccttccatgccaattaaacacaatctacagcatcactctttttctttcttttttttttttacatttgtggcacattccactgtacagatgtgctataactggtttagccatttccctgtgatagtcattcctttttccctattaaaaacattgccacaataaatatccttttacgtgcttgttttaaaacaacttgtctaattcttttcttaggaaagatttctggagatgaaattgtgtagtcaatgaacgtttttagagattctgacacatagtgctaaatgatcctaggagaaaggttttaaccaagtccacaagctgcatgtgagtaactgcttccctttaactatgctaacactgggtattccattcccatgaccttttctcatccaacaggacactcttgttttattggacatttctttttattttgtacttcttatttggtgaaatttcctgttcatatcctttgctcttaattgttctattaacgtgtttgcttttttatatggtttataaacatactttatatattaaggatattacccttttgtctattagtactatttgtattgtcacaattttcctgatttgtcatttacctttattgtatttgtttacattttaaaatatttcaggatatatactttaagtataggataataaaatgattacctgtgcacccaccaccaaactctaatgaatattaacattatgccatatttgtttcaaatcttgctttctttttccttaccaaaaaaaaaaaaatagcaaatacttaaatagcatttgatgtatgccaggcactgttctagtgttttacatatactaaaccatttaaccctcacaataaccgtaagtgatatgtaatgtttattatccccattttacagatagggaaactgagatacaaaggagttaaaccagtaattcaaatgatggcttccactatgaattcttacccatcatgtgccatcacagataaaccaggagccacccatagtactatattcattccaaggtaatcactatcccaaatttgatgtttatcatttctacacatttttacatttttaatgtatataacaacaacacatagtatttctgtattcttttaactttatgtaaataggctatgctttatatattctcttttattcttaacatgttttttattctttgttccttttattcttaacatcatgtttgagatttattgacacatgtataagtattcattctaatcgtgtacagtatttcattgtatgagtacaccacaatttatttatccactttataaaattaacggacatttatgttgattccagtttcccctatgactaaaagtactgtaaagaactttcttatacatgtttccttgtacagatgtgtgagactttcttaagaagatatatatatatatggaattgttgagttgtagggtacacagtttatatctgtgatttaccaaatattgttcaattgctccccaaaatggttgtaccaaatccacactcttacaagctgtgagttcccactgttccacaaccctgtcaacacacagaagtctattttttattctgttagggtaaaaaatagtatttcagtgttgctttaatttccattcctctgtttctcttcatttgtttataaccatctgaattacctcttgtgatttgcttgtcatttcctttgtccattgttgtggttctgtttttatcattttatcactatccctcttttcctattgatgtgtaactcttcaatattgcctggattccatgtatttctggttaaatacttatcataatatcaatttccagtttgtggtagtgagttcacttagtttgtaacatctcttgttgtacagagattataaattttaacaatttataatttagcaatcttttctttcatgatataagctttttggattgttgaaggccttcccaatcccaagatcttaaagcttttttgcttgtttttattctaaaaactttaaagttttgctttatcacatttaggtgttaagtccaattcccctgcatctaatttatgaatgtgatgtgaggtagggatctaaattgattttcttccatgcagataaccattctcccagcatcatttattaaacagtcccatccttttcctactgattgttttattttattttattttattttttgagatagggtctcactctattgcccagtctggagtatagtggcgtgatcttggctcactgcaacctccacctcccaggttcaagcaattctcctgcttcagcctcctgagtagccagaactacaggtgcatgccaccacatccagctaatttttgtatttttagtagagacaggctttcaccatgtcggccaggctggtctcgaattcctgacctcaggtgatctgcccacctcggctggcctcccaaagtgctgagattacaggcatgagccactgcgtccagccttctcctactgatttataatgccacctctgttatttatcaagtcaccaaatatggattgttctatttctgtggtctcaattctgtagcacaatctgtttttccacccctgcaccaatactataatatttttagctttataagatatcttaacatactatggtaaattctctaccttagtccttaatttatcttgatctactttacttttccatatgagtcttaggattatcttgtcaagttccattaaaaaaaagtattgagattttgactggaattacattgaacttataggttaatttgggaagaatttgtatccctacaatattcatactttcattcatgaaaatggtacatcgctctacttttatgtcttcttttatgtttttcggcagtttcataattttttcatatgaaatttgcatatcttttgttctatttattgctaaatttctcatagtttttattgtgatcataagtggaaactttaaaaatttattttctccagctgattgttgatggtgactaggaacactacttggaatactgaggctgtaccccctaatattgttgaactctcgtattagttctaacagcctctctgtagattttctaaaatgatctaaatagacaacaacataatctggaaaataatgtcagatatgtttttcttccttctttcttctatgtcttctcttcatctctctatattacgttcggggcaactttattagatctaaatttacaatcatttaattatcttcccaactgtattaatatgctatttgatgcgtacattgaaattttaatctcaatgtctatatttttcatttctggagattttatttggttctttttcaaagttgtattattttcttatgtttttaatcccttattttatgtctttagttattatgaaggtgtttttttttttgagcagagtctggtcctgtcacccaggctggagtgcagtgatacgatcttggctcactgcaatctcggtcccgctggggatccaagtgatcctgccacctcagcctcccaagtagctaggaccacaggtgcacaccaccacacccggctatttttgtgtatttttagtagagacagggtcttgccatgttgcccaggctggtctcgaattcctgagctcgagcaatctgcctgcctcagcctcccaaagttctggaattacaggtgtgagataccgcgcctggccaattatgaacatttttatcatctctatcaagcagttctactatgtgacatttttaaggggatagcctgattgtgtctgcgtgtgtgtatgtctgctgactcttcctcatggtggaatatttccttctgtgttttataatttgggaaatccagcctgacctaggctaaaggtgtgtccttccagagaagttttgttcccttttaggggccccaagacatcattctaggatcactttctatgttaattttttagatgtaggttccaggactactcaggtgtaaatttgaaccccaaatctgtataaggccaaatccatagtcacaagcctttcaggggttacttttttcctttccagccctggccaagacagggattctttatcatttcccagggcctgtgtgtaggttttttctggttcaccatttttctgaatgtatagtcatatccttacggggctactcagtttcaacccctactcacactgtcccaaggttgaatgtcttgtctctacatgctcattaaaatccaagcctccagattatgcaaatcaacacctccccaccccacccagagcaaccacagagccatttcacatgtttactgctatggtttttaagcttctttttgtttttggcacttggggtttctgttaaagtagcccctcttatctacggggaatacattcccacaaggctcctagtgagtgcctgaaaccatggatattactgaaccctgtatatactatgccttttcctaaatctacatacctctgataaagtttgatttataaattgggcacaataagagattaacaacttctctttgtcatatatttggcttctctttggcacatccgtattgccagcaacattactattctgctttggggaataatgattaagtaaaataagggttacttgaacacaaacactgtgataccacaacagtctacctgataacagagatagctagtaagtgactaatggataggttgcatatagagcgtggatacgctgaacaaagggacaattcatgtcccggagcagaatagagcaggacagtgtgagatttcatcataatactcaaaacggtgtgccatttaaaactaatgaattgtttatttctggaattttctatttaatattttcacgtcatgggtgaccatgggtaactgaaaccatgtttccatggtttcaaaattgtggataagaggaactactgtactttctcatgcacttagctatgtaattcaaaggatgtttcctgtattttaaattgtttattaataggagacttttcagattttcttgtccataatgttgctggaaacagaagtttcatttgccttttacttttatttgtgtgatgggctaaaaagttagctaaatctatcagtcttctcctttgtggaatttgtcttcagagacatgcttagaaaggcttttcccatgctgattatttactcatgcttatttttatggttttgtttcttaacacttaatatttaaactacctagaatatattaaatgcaataaaatcaaaaccttacatattagtaataaagctattcaaacagaacaaaatatagctataacacaactacattgcctgttatcaatattttaacgacaagtttagtacaatgcagttcagctacaacttgctgacccagtgaagccaccagtgctgttcatcacacctaacttgctgctcagtccaacccaatggtcacaacctgataaaaacacactcaactgaaaccctgcataactaccatctgaagaccacccaacatttccaacagtgccatgagacttctacccactgagatgtagctttgccttctgtttgcacatagaaggaaagaaaagtaaaattacagcaagttgactcaaattggtgaaaaaatctgaataggccctgcagagaactacctagagtcctgggtttggaaagtaagaagaaaagaaaatcctcctaccccacagtgtgagagacctacctgcctatggggggtcacttgaacagctgggcctgagacaggctgggtcttcagtaagaacaagcttagatcaaatggggccagaagtccccctaccacccccacaccagcctcgatgatgatctcacaagctcctttttaaggccagtgggatcatggcaactctgccctgggatcctctaaagatgggctgactctgtttacctcgactgatccaatatggccctgtcctgggagttgagagatgaccaactctgcccctgccatgtcatccctcctgtctctgggcctcagtttccctatctgtataataaagaggcaggacttgatttggtatcaagaaaaaaaaaatcagaattagaatccagacattctgacttccaggagcagtctaacaacaacaacaatagcacagctatcatttgttttgagtgcttactgtttatcaatctatgagccaagcatattatacacattatcttatacagtcctcattaccttcctatgaggttgatattgtcatactaatttcacatttattgaattcaacaaatatttattgggccaattactgagtaaactgcttgagatcagctagttagtaagagctgagtcagaattcaaatctggctctgcctgatttacttactacacccagctatccatccatctgtccatccatccatccatccatccatccatccatccatccctccatccttccctccttctatccaaccatccatccacaatttcccccatccaacaacactgatgcaagctccgtccataagagaactacttccttctgcacgcattctcctccacctacaaattacaaaatctcaagtctccacacatttcaggtttacccccagctcacttttgttttctagattctgggcatctgcataaacttcttttcactccaccctcccactccaaatctacatttctcagctccttagaagccgaccctgagattccctccctcctccaagatgtcctctatgatgattcccaccctcaaaagatccttctgtgtgcaggatcccttcttccttacccatgaaggctgtgccagctgcccgaggtcccctcctgccaggatgcccatttgagagccagctgcaggcagcccttaccaggtttccgacctgcagcatctcctcgaattcacttgtcatgttgtagtgctccagcgccatgaagagtgtgttgagtacgatgcacatagtgatggtgaggtcagtaaacgggtccatgaccaccaacttcactccctgcttgatggacatccacagcgggcagcactcccagatcaggtagcgctgggcgagacggttccagcatggtggacacttgtggcgagactcctctaactctgaggggacagccaatgagttagtttgattctgttgactgagtcatatgtaactggaataccttccaggaaagatttatgacttgctctgggagatgacagggctgctaggtgacagcgggacagtgggagcagggaaggccaagggagtgggtggcctgtgtcctggctccttaatctggaaatatgagagaagaggtccatagggacaggaaacaaagatggaggtggggaaaatggggacaggagagattatcaggacaaacgtacaactgcttaagacaacagtcccacatagacctggggacactcaggggaggacaggctgaaaatgatgagacagtaatggggacatgcaagttcagacacgaggacacctgggacagaatgggcagggacagatgtggacatctgggatgtgtcaggacaaatgggagaggggatgccaaggacaggctggaaaagatgagaatacatccgagataggagggaacaagatcaggatggggggtgccccattcagactggaagggatgtggagttgcctagggcaggaatggctgggaaagatgtaggatgcctggaatagtctgaagtagatatgggaatagctagaacaggcatgggtatgctcaggacaggatggtcctagatagacatggttatggttgggagatgatggaatgagactgacaagcatctgggacaggccagatgtgggagtatttgggagaaacacaggcatggtgatacccaggagagaacaagctgaaacagatgaaaagacatggaaggacaggcaaggctacacagaacagagaaggctgggacagtgtggggatgtctaaagcaggccaagacaaatgggggatgcctgggtcaggctgggataaagatgagggtacctgcagcggaagtggggggtgcttaaatgacctggggttgctgaccttccagtgcgctggtgaggacgctgactgcgctgagggcccgctgccgtgctcctggctcctcgaagccatctacacacggagcctgggaggtcagcatctggggcccgcctggctcctccgatggcgtggtctgagtgcaatcaggagatttgcgtcagcctggggaaaagggtcctgcccccagctcctgtcctgctggacctggggaggccggtccagactcaggctggggatgccacagggataggatgaaggtcttgatgggacactggatgctgggcttctctgttcccaactccctcccagttaagaactccctccacccctcctcccaatcactgtctccttcattctcctttcttcttcactgcctctcatcagcagtgattcctgagtgtggtcaggaagctacacatatcacaggtcctccctgagcctgatgctgccatacacattagtacatgcaaaaatgatctgggagtcttaactgaccacaagtttcctagcgtcaagagcataaagaagctgaaaaaaaaatctaacatgctctaagataatgctaatagcaggataaagtacaatgcttacatatggctggtggggggctgtgtcttttgtggaggcagttaggctggatttaccaagaaaattttaaattggccctcaagtcctcgtctagtaatctaacttcataaataattacacatgtgcatcaaaaatacacataaatgatgttcattgcagcagtgttcctaataccataagaacaaaacaccaatcaatagcaaccatattcaaatcaattatagacacagtccaactctgggctctgatagacaacaaagagaacgaggcagttctttggatgctcccatgcggacatctccaagacaaacagtttgatgaaaaaacaagaaaaagatctggaaaatgcataccaaataattaaagtggacatatctggggaatgggattgtgggggaggggaaaaagagggagaagttcccttttcacttcatgtacttctgcactgtggggtttgttttcaccatgcatgcaccatttttatcagtaaaaaacccaggcctggaaacagccctggtgaagggaggtggcaggcaggcattctctaggcttacctggagcctcccacagaaccaaggagggccaataaagccttcacttcagcagggccctgcatgaccacggcccaggtgctgagctgttcagcatgcaatagcaagactctaatcttcatagggcagagggaagatgggcctagattagccagggtagaagaagcagggcatagggtggataccaaatagatctgggctcaagttaaggacatcccggccattggtaggactgctctgaaatgttgcctagggaggtagtgagctcccagtcatggaagtattcaagtggaggcacctgagagggctgaggtggctggtgcaatggtactaccctaggtccaacgcaaccatgaatttggccagcttaactcacaagcaagttttaaattctcccaacttctcccctccttctttgccatctatgatagtttggttatcacttggcacatatgcactctctttcccctcccaccgagggtgaattaacttccctgccctgggcatgaatgacttgctttggacaacagaatgttagtggacatgctgtgaacagaaacctcaactgggctagtgctgtttatcttgctcttgtgctccaggaattctccatgaaaagagcttccccagatagctgtcaccttttcagcctaagcctcagaacaaagatgcagagcagccctgagcctaacccacagcatggagcccagcccagccagcatgccgtctggagcagggcttcccagctaagcctaacctacatgggccatgttgtagttaacttgcagataagtgagcatgagaataaaggcttgttgctagagattgacttctggggtagtttgttacacagcattattattataatagctgactaatacaccatcctagtccaggcagtcatcttctctttcccaaaaccactgcaacagcctcctaactggcttcttttcttcttctcatccctgtattctctgcatagtagaaagggattcctttaaaaagtaaatcagataatgtcactcctctgttcaacaactcctcccaccctactcctccccatcttactcacacagtatatccaaacttatctatggtctagaaggccctgcacagtccaaatcctaactcatgaaattcattttaatgtttcaccacacctggccctgttagtccctctcatcccttggatgtgtcctcctcaggggctttgcacttgctattccctctgcctgaacgctgttcctctgcatctttagggctggctccctaaaatcatttgcctgtcaattttaatgttaccttcttgggaaggcctttcctgagtattctaatagccctcatcctcatccctccccttagcagctttctatcacatgacttattgctacctgaaaatattgatcagtttactgtcttcctaactacggtataaactccaagagacagtgatcttgccttctttgttcactgctataaccctggagtctcaacactgcctggcacgccacatggcaggctggcactagatagatattggttggatggataaattcttgggaatcaatcggaaggcttgggttagagttccagctctgttcctaacttgctaggtggccacaggaaatgaggatgaagatttaacatgtagggggagaaaaggaatggatattcagtgtgcttctcccacctccatctggacttttggaaccaggcagtctcatacaagcaaggggcaaagtaagtcttcagcccctacctcccaatctggataaactgaacgtgagctgtctgctgggctggcccttccttcccatccttgttgattaggcacccacagtgtgcccaaccctgtgctttgttttcagactagaactgggcagaaacgtctcactggggacccagtggaagcacagaaggcattcccaggggcctgcagcctgctaatctctttgactcttcaaatgtctccatcttggtttgctaattcctttaactttgcaaatgaccctgtcttggcctgctaatccctttaaggttacaaatgggccccacagaagtgagaatgggtgaagtcagaattcctggtaatgaagtgcttgaacttggattcctcccgacatgtgcagtacaatgagatgattttctccttaatgagattaggaaattctattagcgctcccagctgctgacccgattccatgaggctgaggctccagggctgaacctgcctggttcagtgttcctggaaactagacaccccacccttcagatgggccagggcctccccagctctacctaaagctgtggtctgcccccaggggtgcccagtttcctcccttcaccctgtgctccagaggagtgtggggccctgggcattctgcagtgtaccccaggatcctcactccttcctgcttactaataccaataacagataatactaatggctctaagaccaggcaagtattggtctcaacactggacctagttgcactctttcagtcctcaccacaacttgctggcgtataattttcactttacagatgaggaaattgaggcacaaagagattaattaacctgtaccaagtcccacagattgagcgagagtctgagtggcacaaaataagccacgtggctgggagccctgcatcttcaggccatcctccaccttcctggtcaagcctcccatctgttctaccttcctctccaagtgcgctctgcaggccttgggggttgagccagatgttcagctttttcctgggtgggctgctctggtcactgtgttgggggcctggggtcagcaaggacacctgatggctgattgggcagccatcagtctgtcatagaactgactaagtgaccaaagctctgattggcctttcacaatctggccagtcccttcctatcacctttgtaacagtcactgcaacttctctccccgtcgctccctctgttccagccacactgacctcgtggcatctcctccaacaggctaggcagagttctgcctcagggccttcacatttgctgttccttgtgtctggaacaggcttccccagatgatggtaatgaaggctttactagttgtgacatagttaactatcatccctctttatcaccattacacacaatatagacattttttctttttgattttttttttttttttttgagatggagtctcactctgttgcccaggctgaaatgcaatggcatgatctcagctcactgcaacctctgcctcctgagttcaagtgattctcctgtctcagcctcccaagtagctgggattacaggcacgcgcctccatgcccggctaatttttgtatttttagtagagatggggtttcaccatgttggccaggctggacttgaactcctgacctcaggtgatctccccacctcggcctcccaaagtgctgggattacaggcgtgagccatcgcacctggctttcttttgagttttgtctgtctgtccccattagcatggatgctctatgagggcccagttttttttttgtaagtttatgcacctagagcccagcacacagtaggtgctcaacaaatatttgacgtgtatttttggacttggcactggtgatcagtttgggagaccagacctgctgtggtgcctgcatctcggggctggctcaccgtgtctggcgggtgctctagcatcacagggcggaggaggtggcttcctggggatgtggcctctgggtcgcctgcccccagtaatgagaccaccccattgcagtccacagtgctgttctttttgccatggagggcgtggccaggagccgaggttccgggactgggctgtccctgggcactggtccggcgcaggggccagggcaccagcagtgatgtgtggtggctctcgctctcccccgctgtgctgttttcatcatctgcaaaatctgcttcagaacccaggtctcgcctgcgaaaggtgaaaatgctcccgcggctggaacgtggcttcatagaagtcctgctgaggccacgggtgaggctgagatgattctaagggcatgaggagaggggacacgaccatgacatgtgctcttcatgtgctcccagcctgtcttttgtgccactggcctcagctaaacttctcagagcattgagggcttttttggccacacaggaaccaggtgggttgggccgggggtatttggaagaggggatgtggggttagagataatcctgtatcttctgggatgtctactcccctcaaatctatgtctctggagctgggagcctgaaacttaactgggcttggagttagagctcaggctgggcaagggagaaggaggcaggaaggctcctggtgttgcagacaggcccggcctgaggaggacctggggcactcggaatggaccctcactcttatgggcatgtccttgaactcctaccaacccataccatggggtctcgtcccccagccccggctccagtgccgggatactggcctcaggttggggatatcacaacacccaaaactaccctgtccctctgcccagagctcccctactctaaggaaggccatgggaaacaggaagcgcagagatgagcaaccatgggggctgtgactgtacaggggcctagcatgatgggattttcatgccagacccaccctggaaaagctagaaccacagctgggattaccattgctctgggaccatcttctgagtcagacttggggagcctgtcctccccacactcctcagttcctgaagacatccgttttctcctcttgcttcttctctcatggctgtttactggggccaaaggggacatctccaaggagctacgggacacggtatccacacccctgatggtgagggcctggaaaagagtggaggaacggacgtttccatcattgagactttgtgcagcctcaggctcaggcaggccaggcaactctcagtgacttggttttccctatcagtaagtggacttgcacacctaccccaaaatgaggacatcatggagataaactcagacagacccagaatgttttgggaaagatcaagatccaggaaggaagataggagtggctaaagtgggcagcctcggaagactggagtgtgtggaacaggtgggaggtgggtgtagatgagcagagaagtggcagaaccagaaggcagaggctcttctagaaggtttagctggccaaaagtgtactggaatatgtggcatggggtagtgagaagaacaagtggatgcttctaatagctctggcttctaatagctcactctatagccagcctccaggctccaccatgtgggggactagggatggctagggcagcattgtcagtgcttattttctgagacagctctgttctctgacattggaccttcttcactaccccaccagaaggcatcccttgaccagaataaactatgtgcatgtatacatgcatctcttatccagcatgcactatgctcacagggaccatctttacccaggagctaccacccagcaggcaccatttttacccagctggcgccaccttcacctggaggacatgacgaccatagggaacaagtttactcagcacaagccacactcataggacccaccttacccagcagatgtcacttttacctagtaggctcctcactaacaggcacgtcttaacccagcaggttccaaatttttactcagcgataccacattcacagaaaatatctttacccagcaggcactgcaccatgcccacaggcactggctttacccagcatgcaccatgcccacaggcaccagctttacccagcatgtaccacgcccacaggcaccagctttaactggcatataccccacctataggcacctacagtcaggtgagggcttagaggctcctcggtggcactgctcacccacctcgtgttctttcttgagcatttccatggcctcctggaagcgcttttccttctcctcggtctcagcgatggtggcttggttttgctcctcataggccattgcgaccacggccaggatcaggttcaccaggtagaaggaccccaggaagatgacaagcatgaagaagatcatgtagatcttccctgcggacctgagggtctgggggagcaagggggcagaggtcaccctcactggggccccttctgggttatggcatttccaagtcacctagtctagttgtgccaggggttcaaatagccatagcctagggaggagggtagagatgtcccacctatagagagggacatgtactgacctgcagaggagaatgacctgcacacagcgggactgtgtcccacctgaggagggaggcagaatgttccacccaactcagggcatgctgtgcccacagagggagaatattccatcctacagggagaaagagtgtcccactcacagagcagagagcatcctatacaaagggactggtacttcatcaccagcaaaaagaaagtttctttgctgctgatcccttctccctcagaagcaagggtccttgtcccctgtcccctccaaagctcccaccagtggggaggctgctggggccacttctggctagtcacttgtgtagcctggaccctgagcccacacttgctgtcccttgtgggcacacacacacctgctgatagaggcgctcccagcagtcctgcgtcatcaggcggaagagtgcaagaaaggcccaggcaaaggaatcgaagctggtgtagccgtggtcggggttctcgcctgcctttaggcaccggtagccctccggacatgtcctgcagccacacacagagactttgttccatgccgtcaggggtctgctgcccttgagacccttgctgggctggacttgtctccctgggcaacccagtttatgccccacagctcagtgaagctgagcttcacaaacctagtgccacgctgctggatcctgcctccgtgactttgttcgtgctgtgcctcccactgggacactatcttcctctttactcttcttatatgtactctgctaggcctaaatcaagctcccttctgcccatacgtcacaccatccccagctactatcaagttgcctctcctcacagagaggaagcacacaagcctggctcatgtctcttcctctgcccatctaccccatgaggagttgagtacagcatgggcatgggggagagcagggttggggagagcagtgagcctcggctgagctgaacaggatgagcccagggcaaaggcagggccatggggttgagaaatgattctggaggggatgggctggggcttggccatgtcaggagctcatttgcacaactgtgcacacagccactggttcactgaggcagattcacagttcacagagctggaggtggtagcctctctccaaagaggaaatgctggtctggagtcatgtgtgcatgtatgtgtgtatgacacacacacacacacacacacacacacacacacacgagggacttagcaagtggatggatgcatccaagggacctctgtgtcttgctaatgccccaagaccctccagacaatctctttggtgacaggaaggaggcaacaaacttggtacttctcctttgaggtggccctctgtgacccccttctccaacactccatggcactgtcacagtgatccaggccctggtgtgcacagggccctggaagctgcacatggctactgggcatctcaaggaaagtccaggctgctggagaaaccacatttgctccaagggacagatcagcagcaacggagggaagactggagctggagggagcagttctggggagcttctggaagggaatggagctgggggtgggctggttggggggctgtagaaggcatcccaggctatccctcagtcccagcccaccttcagggctccgttagctctccctgcagctctgtccctgacctttctccagaagctgtctcctctgtgctgggggcaaggtggggaagctggggaagggtcctggcaggtaagggagacaaaagaaggcctcgctgtccctggggtcagggcataaatagaaaatacagtcagttgagaaaacaccaggagactcccctggcaggacaaggagacccggggtggtaggtgccacatacccagcgtcagagctgttcccacacagtaacacatcagaggtgccgttcttgagcaggtaattttctgtaagagaaacatcatgctggtgaggggcactctggcccaaaagtttccgccttgcatccagggctctggggaggtggagacctcactagcggtcttccttcttctctgccccttccctgcccctgcccctgccctctgcctggccaggcttcaggcaactctggctgtgcctctggccttccttctgttcctctgaagacatcctgctgccagtgtccccatgctctcagaagacacgggaagccctgggcagggcctcagctctccccacaggaagcttctgcaccctacccgaaaccactcagggggcccaccaaggccaggaggcaagggtctgggcagttacggcttggctgccgagtcactgtggggccttggccggctactgcccagctctgtactcacttccatcacataaaatgctggaagtgatgcctgcaatagtcaccatgctaacgctgtggtctgtccggatggggctacaccagacaggactgcccgtcttgtcctctcctttctgtggcaagtcatcagtccccaacactcaccattacctggctttgtcttaggcgacagttgtcaaagcatggtcctcgaaccagcatcatcagcatcaagtggaaactgcttagaaatgcaacttcctgactgccacccagacctactgactcggaaactctaggggtggggcccagaagtctgttttccagagccttctaggtgacttgggtgtacatggaagttttagaactgctgttatgaggccactgctgaactactcattgagtgtctatgttttgttttccaaagtggactgctggtgtatgtaagaggccctaacttcagaatggccctcagggtcattctggcccagggtcctgtggcctggaatctggccttgcagcagcatgtacctccgaaacagaccaatggctctagtcaagagtggtgctggccatcagcctggagaatggaagtgtgagccacggggcagtgaaacaacagaggggctcacacaacttggcacaatcattgggcttgttccaaccctcttgcagggttctggggtacacgtatatggaacgagcatcctggcaaggaacactgacggcaactgggaaatctccatgccagctaggtggggcttcactctgaagcctcatcaactacgctggctccatgtccacccctttcctaagctgacactctgtgggcaggctggtcaccttgccattgcaacactctagggtcagtcccatctccaaatgccgcagccaactggccctctatctaactccatactttccactcctcaagcattgcctctccgtctagcctgggaagtcacaaggcaggccctaagtctgctacccgtctgtcctctgtctgggtctctgggggatcaggcagggcttgaacagccctggaggcctgccctctggtgacgcgtgtgtgggaggtgaccccggtctgctggtctcacaaagtcttccccagctgcagagcaagttcgcacctggatcactgaggtaaaggtccagggattcccagaccaagccgtcggcctccacggagccgttggtgccgttgagcgctgtgaagttgcgcacgcacttgtgccttaggttgcccatgaagagctgcaggccgatgagggcaaagacgctgaggcagaagactgtgaggaccatcacatcagccagcttcttcacagactggatcagggcccccacgatggtcttcagccctggggaaggcaagaacaagcacggggtcacccaggggcaccgagctctgtgctccactggtggggggctgggcctgagttgagctggggtggggccagtgtaggcaaccagaggtggggacagaataagggaggcttctcctgggctttgagacccaagccccactttcctcacagctgagattctgtcctgatttccctgggcaggagtctaggctggctttgtagtttcagagggagcctgctcctctttgctctccaccagccaaatatatggcatgggtgtggaaagtgctgctttcttgagacaacacatactcagagcatgaccccctttggctagtctgaaggtgtgctaggcctaccccttttaatgtagtccatggaaaaggagatggaggcaattgaggggcctcagccttgatcttgagatggggagaaatagagccattcctgctggaggtcctcctgccccactgctggggctggctctatttgatgtacagggagtgtggattgtttggaggaaactaggggcccagggtctggtcgggtaggggctgagggctgtggtcaggtgtgtgctgggggctgtgggtgacggtctggcggggtcatggcgggtgatgtctaaggggcctgcgctggctcaggcccacctttagggaaggttcaggaacaggactgacctgcattgcatcttctcacttgccctgtccctctagaacctccccacacccccatccatcccatttcccatagctgagaggctgtgttctgttagttgcacagcctagctccctgcagaagccagcaccacatagcagaatgacagaaaagcatgtgtagacaccagtctggcccttagcgactgtcctaggacaagtgcaagcagagcatggggaatgaggaggctcctctgccagcggcagggccctgcccctcatgtccctgtcccaagcggccagatctcagattaagctccatccatccactgtccagccggttaatgtgttaggagcgcctgtggcttctgtgcctgctgctgctgggcctgtgacccacaggcagggaggccatgatgagcaaacacaagatggggagaggatgacctccccatggtgccactgacattgctgcccacccagggctcagaggcactcagccttccttgtggaaatcgttcctggcagatgttggcaactgcctgggcagtgggtggacctcacaggtctgggtccagagtagtggcggtggtgagattcacaagctcttcatggtccagagctcctcatctgtaacagagcttcctgtaccctttggtgggtttactgggctggagacctgcatgtctcgaagggaacaaagtgaagactgatggacagcagctccaatacccaaactggtctctgcctcaattgttaggctaaagtctctttggcctgaagtatcccattcaaggccagcaaagcaccccctgacctggtctgtggacatagtggccaagggtaactcacccctttgaacatttctcatactgatgatagatttcacttctggcaagaatggttgcaacgaaactgcaggattctttctgaaaagacccaggaagggattggccccaggagatcaactgggaaatcctcctgccactgaattaacaggctgggtggaagagcccttggaaatcaccaattctgatttcactctcattttatggaaaagcgactgagtctagagaggactagggctatttcagactcagctcagaggacacctcctcccgagggccttccataatgccgaccatggcatttttctattggccactttcagagcctgctggctcactaggttgctggcagctgcgaagaggtcccatggagctaggctgagattggtgggcttcctccttttccccaggaccgagaaatatttccctttgtaaatctttcttataaaacacaccaggaatatgccttaagtcctgtggttagtgtgtttgtctacttcggtggggtgtgtgcctgtgaggctctccccagggccctagaggacagaccatgtggtttctgagtctatgtgtgccagggcccatgatgtctgtctcaatgcaggtggctccatgggactgagcgggagcagactgcctccttgctactggcccttggcaggggtctgggccacttgtgggagctctgggggagatgcggcccttatgaacatactatagtgggtttagaggccagaaagctcaatgtgaacatagcataactgggggctgctctggcaagataactagccctaccagggggagtccagattccttattggagcttagagcagggcttctgactccttgggggcgacaatagctcaatgcaggcctgggagccaccaggttccacatcaggtgcggatgtagccatctggttcaaccgatgcttccgtcagctctcacacctccctagaatgatggcatgcaacctatctccagctgccttatttatttatttatttatttattttgagacagagtctcactcggttgcccacgctggagtgcagcgtgatctcggctcactgcaacctccacctcccgggctaaagcaattctcctgcctcagtctcccaagtagctgggattacatgcgtgcaccaccacgcccaactaatttttatatttttagtagagatggggtttcaccatgttggccaggctagtcttgaactccttacctcaagtgatccacccgtctcggcctcccaaagtgctgggattacagatgtgagccactgtgccctgctgggctgtctttttaaaagaggtgccttacccagttctaagtgtggctgctttcggaaaagacttctggaaggaacctctgggcactgcccctccagagcaagttcctccaaacaggaggagctttgagtctggggagagggaatacaaacttaggataggaatgtctcctgggtggaactcagcttcagcaccggcccatcgcacaaccaggctcagaaatcacaagtcttttcagagttttcctagatggatggatggaatggtttctagagatgttatctgggcctagatttcccagatgcaattgccaacatctgtcaaggagaatttcttcctgaggctaccatgcatggtttgctaaacctctaccgcaccatgcagcgagggctgttagacaccaaggcccgatgatgcctgtccacagattatgctttgtttcacaaaatggggctggggctctggccctacttctatcaccagatggggcacaaggcgggccgaggcactcaatcatgaaggaccgtgctggagttttcctctttcactccgggtgtgtgtgggggttcccacaaacacacttcttttggtttcctcatcagaatctgacatttcaggctgaagcaattcatgtaaaacttttagctattcaaatagctgagtgtggtttggaaaagcagtccactatcttggaaaaaatttaggttcagtgtaggccccaccgtggggtgctctgtgccccctggtgtctatgagagtgggctttgctggggtgggcagcctgaagcccattctgaggctccagggggacaagcatgtccactgccaatagcccctggcacctgagccctgggaaaggtattctggtgacaggcacattcgaagggccttctggagggttgccttggctcccaggtggctggaaaggcccaggcatatccctctagccttggtgtttaacctgattttcacctgaaatgactgatatagttttcagggcccggaggactcggaaggtgcgtaaggctgagacattgcccaggtccacaaattcagttgtgtatctgtaacaagggaaattcacacacgagacaatgacaacacaccaataggagacacacagtcagaggaggaaagggggtggggaagacagagagagagtcacttgtagctgagatctgagaggcaaacctgggcatcttacctgggataactgaaatagtttttagagctctcaggactctgaaagttcgaagagccgacaaattgcctagttttatattttctgatacatacctgcagaatcaaaccacagttattgggaattacaaagcagaaccaccgcctgccctccccgaccagccctctcccttggccccctcccacgggggtgggggcagtgctgtggatagcccagggcctccctcaggttttcttctggatttcaaccctcctaacataggacttcggcttgagtgccgtaaggatgtccacacagcaagcttcccggtggctctcttggtgatggtgctaaggataactggtgctagaaggcaaccactctgccactctcgccacaccactgggacccatgacatgaaaccacatgtggagtctggggctggggacacatcagagtgaagagagaagcctgttttccaggaggctcaggtcaggtgatacaggaagcaagtgcatttctggtcctagttttggttcacatcttctgtgatctgttgatcagcttgtgcctggctcagaagtccttgaaatcatgaggtggaggtggcctgaatactcattggaaaaaacagagttcccaagacagaggcactggaagatgggaagagaggttgcctgaatatctgttcttccaactactcacaggcaaggaacaacccaagaagagaaaagggcaggatgaggggctccaaggcagtggagcgccttcccaagtccaccggtcccacccccagacccttggtatcttccagggatggccctgggtctccaccggaggagtggcctccagaagcaagatgcccttcctggggtctgtcctgcttgggtccgagtgaggatcagcagggcaagtggctgtgggccccctcctggaacttgggcagttgcccatctgtggcctccacagggacaggagtaagaaggtggtctctggggggcagggaccaagcagagcatgaggacatgcagtatatgggccacatgaccacgaggaccacagacagtgtgtgaccaaggccatcaggacagtggcaagtgacttgtgacatttaatcaaaggctttgcatccagggtgtgtgacatttaaccgaaggtgtctggtatttaacaaaggacattggacttgggatgtctgatgtttaaccaagtgggtctgacgtaggtgtctgagtgatgtcagacagaggacgtcagccctgtggctctgggtgagtgcaagggtgggctggcactgttgccagactcactctgctgggcggtctggacctccaggcccttccagtctgctcccagcttcccaattccccttcaggctttgaatatctacaggaaagaacttggccagctgagtcaaggggcttaatgccctggggtccacaggtctggctctaattgacactgggctgacaccagctttctctatgtccactggaggagcccctccatcttcacatggccctatgcaccatgctgatctctccttactcgcaaagccctacacagatgggacgtcagcagacacactgccagagcttgctttcctctgatgacaccagaccctttctgtggtgtggcttccatttcgtctcctgtattcacttcagcatgtacatctttctccagcgtggcagtcagatgcagtcccatcatctgctggggagcagaggtcactgtgcttgttctggctcatatacacctgttaatttgatccaagttccctctcaacttctgagagctattccattctccacgacggctcagactctcagggctctgtccaacattcttctctcggtctctctccagacatggtgctgccacaggactttctggctgagcctgggatattgctgaccttgccatcccatggaaacatggctttggcctgctggaggctctgggccccttttctggctgctgttctaccgggtgtggctaaggacagcagctccccttgcctaggatactggtttcgcggctgtctcttctagttacagggagtgagtggaatactgtgcaggttagagagggaaccaaccgtccttgcttcaacagtccttgcttccctcctgtcccttacagacccagtctgtcccctggtgtctccattgaaaactctgcctatctctagcttatattctgcctgtctttgcttgtcccagggtggaacctgcccccagcacagtgtccccagcacagacagtgcttggcctccattcattgtctgccttctaggcagctggtgtcccaaggtgacaaggacagcttagtgacagaataagggaggaccatatctgtgctcctggcaggcttgcaaagccagctgagtggctggaaataggagtgcagctggtggccgtgtgtctgtctgggagagcaatcatgagttagaggaagtcttaaaagaggacttacagggtaagggtgtggaatgtctggggccatgttggtgacttggtgtgctactgcctcttttattctacccagatccccactgaggcctcttttgggtcctctgagtgtggcagggctggaggaatgcttggtatgacacagggccagttgcagaggtggcaagtgtggggtcacgtgaggggtcagagctttgcccctctcaggctggcaaaaccctcctccaggccagtctgctccttcagtgatggctaagctgctggccagaggcagacagctggacagcagacaggggcagaaagagcaaagggtggtgggtgagaatcctatcccatcaccagccccactgcagggaagccttcttcctgcccctcccttatcttgagatggtgaagcccacgccgttagtgactgcaggaattgccaccctcctctctgcccttcctcccttcccctccaggtttggtttccataacaaccccagaaggtgggaggctatgctaactagcaggtaatgcccttctgtgagtggggccacaggaagagctctggctgagcctggcaggcttcccagcaccctgccccagaccctcccacagcctctaaatcagtggggtggaggatcaccccagcagaaacatcagactcggggtgcctctcccatccatcccatggttaggagttgggagacttggttttagtctcagcattgcttctgattcagtctataactttgggcaagtgctaggttctctgtgagactcactttctccatctgtgtaatggaggtcagatggaggattccactgaatggaatgtttcccttcactcaaatctcctttgatcatcctagagtcccttgttactgaaccattgcatctctaagagaatgcatttcaaagccagaatccctgtcaatcaaagctgccaggccaggccagccaagggcccacagctgatgtgccaatgggtcacacagccctacgggaagtggatgtgccatttctgtgagatgcttggaaacgtggagagtgtctgagcttctgaggccgagttctgccttgtcagcctcggccctggcacacagcaaaggcaagcaggtttcggtgaggaaggcacacctgctttgtgactcccagtgaaagaagcggtttgggaatgaaaccaggattctcccaggagacagggcaggaggacttgttaagggtctgaggtcgctcagagcatctcccagagacacagcctgagccaaagcttggcccagggcaatgacttttcctgggatctggggctgcctctgtggtgatactgtcttgcccaggctccaggttggggagctaggaaaggctcaggcagacggtgtatcctctcctgcccgaagccaccttccttcctgtgacacccagcctcaggacactgctgtggattactgcttcccacccacagggcaccccacggcccagcctggcaaccctactccattcccaagtcagtgcaacctcctcggctctgacatgaaaagttctccctctctctgaaacctcagatgtgcctccccactctgttctcagctgatgatcaagcttcttatttcactgagaaaatagaagcaatcagaagagaaattcctttcatttcattatcaactcttatcaatctacctccatctccacctgaaattcagccttccccactcttcaggtcgatgctcccccttggcactgcattcccaccctcttgggccagctcacgggctttgctcctgcaatccccttgctcatctacatcatctagcattctctctctactggatcattttcaccagcctgcaaagacaccccccttctttaaaagccctcccttgattgacccacattccgcactgaccactacaccattttcagtcccattttatagcaagccccgcaaaatagatgtctgtacttgccacacctcctctcttcccactctctcttgaaccctccttaaccaagtgcatgtccttttcctccactggaacctctcttgtcaagggcaccagtgaccttccccctctgtcaaatccaatagtccattcttagtcgtcaccttccccaacctcccggtggcgggtttccagcggaatcacattccttcccagacactgctctctcctgatttgcctctgccctccagccttctctcttggcctccagatgagatgttggggcatcccacagtacattcaggctacaggctacactcatgcctaggtgatctcatctggtctcctggctttaaataccatctgtatccccatagcttctaaatttatacttccaccttggagctctttcttgaaccctagactggaatatccagttgcctactcaatatctcaccctgggtgctttcaaatgtcatacatcccaaactggacttttgattttcttcctacttcagccagtgtcgctctctccaattttccatttcaaccaatgggaacaccgtccacctagcagctgctcaaaccaaaaaccaccttggggggcctcctgtcagccctacctgcaaagtatgtccagaatctgaccaggtgctccccttctccacttggtccttggttccagtcactatcttctgtctcctggcttccaagatatagcctcctaactactccgtctgtctctaccttctccagtctgtggtccacaccatagccaggggagtctctacagaatgtaaagcgggtcacagctctgcctgttcttacaccccggtgactcccatcacacctggcttttaccacgatctgtcttccatcccactactctgcaacttcatctcccaccactctttccttgctcgcttaactccacccaggcctaaatccatactgggtttggggcaagtaagtggtattgtctctcagagccagttttcccacttgtaaaatggagggctagagttggcttacaaatagtgtacctagagacagagattctgatgcattttcccactaccaggttctccgtctataccccattcaccagggtatagtttccctctttgtcctctctccctgacagcatggctgagctcagggctgctcatgtctggggttaaagcctgccttcaataggtagattcagggattccaagcatcctagaaagtgagagctgaattgagcttctgataccacagcacacaacactatcctttcacatgtcgggaaactgagggtttgcaaggacagggggtatgagcctcaccagctctgctccttgctgagatgcagtgctcagccctgcacacactaggtcctctgcttcagaaaggcctttttcttttttcttttttttgaggcagtcttgctctgttgcccaggctggagtgcagtgatgtgatcacagctcactgcagccttgacttcatgggttcaagtgatcctcccaagtagctgagactgcaggtgtgtgccaccacacccagctaattcttgtgtttttcataaacatggggtcttgctatgttgcccaggctagtcttgaactcttgagctcaagcaatctgctcaccttggcctcccaaagtgttggaattacaggtgtgagccaccgcactcagccttcaaaatgcctttgatggttgagcctctgatcacgacttctgcagatgtcccatcagaacccagcatctgttcactgatacttccagggtggagtgcagcctcaacactgacccctcagcaagggtttctcctgtaggcaaagaggcagggcctcagcctgggctgcagcaggcctggggtcacgttcactttctggcaggctccctgtgtgtccttggcatcagttttctcacccataaaatgggctaagccatccccaggtagcctacttctctggctggtgtgaggatccactgtattgtgtcagtggtcgggtgctttaaaatgtgccaaacattgagtctctggatggagcaagctgatgtgctggtgcgactggtgtgagttcctggggatgcttagtcacttctccaggctccttctcttggctgcaatttcattcttaatcatcttggaatccaggtcaccattcgcagtgggccaggggttgaaatattggtttctcttggtggaaagggcagaggatactaaaccagaatcttaacgatgtccctggagaccagggctgccgtggagccccaggtgagccagtaggcctgaccaccaaggcctgcctgagctgtctctccccaccaggatgagctcagggcctccaccctaccttcctccagcctgtgtgcagagctgcatgtggactgcagggaggaagccagaaagagaggggtggtctggggcctggggtggtgcacaccccaccccagtgtggcctgcaaggcatagcacagcatagcaaatgagatacttacgccatgataatcacactaaagtccagccagttccatgggtcccgaaggaaagtgaacgcgtgcaggcagaagcctcgagccagaatcttgaccagagactcaaaggtgtaaatggcggtgaaggtgtacctgggcaggagaggccggtggggtttcttagggaggcctgagcaggccaggttctccaggttccttacgtggtgtgagccccacaaagctcccttcaacagaggccatcaaacggggctctctgcaatgcccccatggcagagctggagttggggatggaactttgctctaaacatctggctaacgaatccatcgtccaatttgtttattccatattatcgtgtaactgccatgtgtccatctgaactctctgtattctctctcggttgtcttggtggaagaagacctcctcccaatctcctcaccccagccctggggggctgtgcatgcaacaggcatacagtggccacagggtctgtgctataggacagtgtacatggaccctcacccctgtttgtgggtcctcagcagctagcaatgggcccagtcaatcctcaactgcttacagggtgggtgggtccagctgtccaccttgggcttgaaggggtgttgatattataatgcatggggctgatgggagtcggggtgctgttctctctgcctagggcagcctgaggaatccaaaatgcctggatgctgggactgaggcccccagtgctggagcgggagaggaccgcatcccaggattcagagcagctgcacgtaccagctgagagcactgctaggttctgtgtgaacatggagaacaactaggcagactgctttgggaagagagctgccccaacattctgttggtctcctgaaaactgcagccaaatgcagtaagggcttatcaagtctgcttagaacctccaggtaaggtacttttgtttgggaagaaaagaaccagaagcagtttctggaactgtgcaaatggttataggaggcaggacttgggaaaaaaaaggcagcagagtgtgttactgaagtggggatagccctggggtacctcctagctgcctacctcctagctgcctacctcctagctgcatggcatcaggccagctatttctctaattcttagtctcatctgtgcaatggggaaggtggctgcacccaccctactgggtggccatgagggttaaaggagatgatgcttattgttcttatgacagtgcctggcgtgtacaaaatgctcaataaattattattatttcagaactttctccaatgtcatcattcctctttaggcaggacagggagaaactttctactttgccactctggagagcttcctccctagaaggcacaactcaaattaatgccagaagttggcaggactgggaaaggcaaaagagggtagaagctgagccaagggctgccccaccgccatgggtaagttcctgggcctggacacaagcccccttccagggcagcttcaggagccatggcatggaatggaaaggaagggagggggccacgtggagaagaggccctgaagatactcactcgacatacttggtccagggtggagggtcgtgctgggccatgaacacgcagttggtgaggatggtgcacatgatgagcatgttgaagagcgtgcgtggggtcaaggaaagctgagcagcatgggccggccacgccaccaccgctgggggggtcctgcccctgggggtcatcactgccaggccagtgctaccagacaataaacagggtctccaaggagacacactggggctgtgaccagtccatgccaatccccctccacccaggctggtctctttcccttccccggcacttgcagctggccccctggcctgctccatgacacctaataggcaccagagacttgaaaccacactgctggtagggtctcgtgtggagggaaggcaggagaggtgggccccagacctcaaagccttttaaccgcagtcaggcgaggggccctgtcctcagtcacataggagagaaatgggcatttataaattgctcctcagggggagggcaaggccagagtggcagggctctgagttccctcctccacttctaggggagcagcccaggccaggcgttgtctagaagttctctgcagaatgccctgctgccaaacaactgcacacctggccagggcctgctacccctggggaggcaggggaccactcctctggctgcttcctgcctgtgcacctagtcttcaagctagccctctgctccacctgggaatctccttctcaccctgcaggagcccgtcagtaggaccccacccaactccctagcagcctgtcctgcctttctggtaacacggtgctgcctctgtgccctgcgggcttcgggcacccctcttttagccctggtggctcactgaacggcaatgtccatctgtctcccatcacaaggcagcgcttcaagtaccagagctgtgcttcaggtctacttgtgggctcttggccttgaactgaactgcccaggacttctctgagcctgactctggctacaattcctagctgctgcttcaggctagacaaagctccaatcgccctcctccacctctgcaaggcctgcagaggaacaagggggcagactctgggcctcctgtaggctggggcacccctggaggcctggcctagagcagggacactgtgcttctctcacaaatccctacccagccccagaggagtggctaggccttccactccctgtggctgcccccaagcgctcaacaccatgcccggcctcagccccgtatgcacagctgccaaactggtgattcccacaggccgcccaggagctgcggtaattgagctccaggggctgcctcttgcctccctagcatagctccacctcacctgatgggaaggccagtgcagtccgagcacagaccaggcctggctgcggtgccgactgcccctgctggggacagtggggatgcctctcgggaatctaaccaggtagatgccctccgtgctgctcctcttctagggagtcaggcaatcaggaaatcagcatctcaaaccagcctccagtttataattatttagtttctcatctgggacgagaggaaattaggctttgggactctcccttagtcaaacaaggactgagccaacaggactgctcggctctgatgccatggctccaggaagccttgatttctccgtgaccagaaggcatcacttcaggccctggggtccctccgtcagtttggtatctgcccagccctctgcccgtgtgagggtgtccagggccaggcttatatccctctccagctttcaaggcaggatcagataatcatctcagtatcagtaccccttctcccttacacacacacacacacacacacacacatacacacacacactgcccacatgcggggtatgtgccaaggctttcctcactaggcagatggttaacaagccccccaaccagtctttattcatccccacggatctgctgctaagcatctactggggagcccaggtgactcctaaaatatgcaagcaatgatgctaagagtgaatattcattgagcccttcctaggtaccagaatttgctctccgtgtccatcagcgaattcagttttcccaacaaccatatgtgatggggactttgtttccattttaggtgatgagaagactgaggcacaaagaggttaagttgaaggtcactgtggtaggcagaataatgcccccaccacccccaaggtggccatggaggaatccccggaaactgtgaatatgctaatttgtatgacaaaatgagaccgtgcagatgtgattaaattaaggatctcccctggcctccgcgagacagggtctagctctgtcactggggctggagtgcaatggtattaccacagcttaccgcagtcttgaaatcttgggctcaagagatcctcctgcctcagcctcctgagtaactaggactacaggtgcacactaccatagccagctaatttttaatttttttttgtagacacaacgtcttaccatgttgcttagctggtcttgaactcctgggctcaagcaatcctcccacctcagccaccaaaagtgctgagattacaagtatcagccactgctcctggccctaaattaaggatcttgaggtggggagatcattctagattatccaggtagactcagtataatcacaggggtccttttaagcaaaagagaggcagagtgttgtgacatgaaattcaaccggtcattcctggcttgatgatgacagggaaccacagactaagaatccagtgcagcctccagaagctggaaatgcctcggaaacacattctcccctagagcctccaaaaggtgtgtagccctgctgacaccctgagtttagtccagcaagaaccattttggacctctgacctccaaagctgtaaggtgataaatctgctttgctttaagccactgcattggtggtaatttgttacagcattcctgggaaagtactcctggtaccaagctgatcaatggctgagccagcatgcaccctggttctcctgatctgggccccactctgaggccccatgctgcaccacctctgcaagatgacattcaaggccacccggtccactctcctgcctccagactggagggtctgcatgagtcatgctgcttctggctctcacatgccaagcaggtaagctattccacgcctggcctctgccacccatggggcggtgtgaaaaccaaacgaggtagagagcaccgtcgaatgtggggagactaccgtacaggagggagggaattatttgttatttgtaagaggaaatcccacttgagcatgtgtgtctggccctgagtgggagccaggggggcaatggagccatgtccccaaaacgctctgacatgggatattatgaaaaaaccaaacatgcctctggctgggctgggcaggaaggcttcctggaagaggcatttagataagcaccaaggctggccagggttgctccagcaaccagtcagcccagctggtcatggtgaagcagcatgtgctgaaggctgggtggtggactcctctcggtggagccaagtcccttccagctctagggggaccactcacagctctccttagagtgggggaacaggccccattgcagggagcagtggtgtgaacaggctgccttgtactacaggccttggctggacccaggcagaggtgagtgagacttgaacacccagactcagggaagagccagggcacacagccctctggatcccaccagtcaggacctgggtcccatggtgggcaatgacaggagctgtctatctgggttttaccttttccagacacagcaatggcttagggtgacgtgtagcaagctcttgtctctctgccacttcactgctcaaaatccttgcctggttcccatggccttgaggacagcacttgcacaattgtcaatccttcttctgcacgtatgagatctcttccttcctagactgagcacccagtccatatgactctgcctaaagcatacccaggtcccccatggcgcccagcacgtagccaataccatagagacgagtcaactgaactcctggccagggcacacctgtttgcactgccttgtaatttcaggctgatgattgagctggtcccttgtgtgggctgaggcaaaggccagctctccaggtctatgctcagctgaacatcttcaatcttgtcatgtcattgtccctaaacacccactcctagcctcatgataaaaatgccagcaaggagtgcctgagttgtggggaatgcctgacacttgggctgcctaagtcttcagatcccagggagtttaaaaaaaaaaaccacccaaagaaaaggtaattaactctggaggggtattttcatgtgtttgtgctattaaatcaacaggcacacacacatacaccacagacatgtggtttgattgcccatttgaatctggtagaggaacgtgggaggattttgtgcacagatcctatacaaccaagaaggcaaaatacttctcagtgtgtgtgtgaggcctctctgaatgtgactgcggtaggatatggagttcagttggtttcttttatttaatcccagcaggaacacattctgcaggattataacaaaaatacatataaaaaaatcattccacatgcccatatttactttttggtaacttcccagagatacactgcaagcatggagccaagaacaaggccaagcggaatcactgcgcacttgctacggtctgtgagctcctggattgtcacgactgagcaggttttctcaccaggctgcattcctgcccacttttaagtttgtctttgccccacttaccattcccaaagggcgttgcacagaactttgcacatgtggaacttagatgtttgaatgagcataaaaatttaagcacagcaaaagttcaccattcaaaacatgagacctgatgttctttagaaatgcatagtgactgataatgggcacaggatttcttttggggtggtgcaaatgttctggaaatagatagtggtgatggttgcataaccttatgaatatactaaaaaccactgaactgtgcacttaaaaatggtaaattttggctgggtgcggtggctcctgcctgtaatcccagcactttgggaggccgaggcgggtggatcacgaggtcaggagttcaagaccagcatggccaagatggtgaaaccccacctttactaaaaatacaaaaattagcccggcgtggtggcggacgcctgtaatcccagctactcaggaggctgaggcagagaatcgcttgaacccaggaggcggaggttgcagtgagccgagattgcgccactgcactccagcctgggcggcagagtgagactccatctcaaaaaaaaaaaaagaaaaagaaaaagataaattttatggtatatgaagtagtatacctcaagttaaaaaaaaatcatggagcacttacagatttctaggcctcacactggtgattctggtctggaaagagctaagaattttgcatttttacaaacttcccaggtgagactgagatggccctcagattagcatttggaagcaactgccctagggtggcatgcacatgggaccttgctacacataggttctggggtgaggcccaagattcggccactcctacaacatcctggtgaagctgatgctactggtccacacaccacactcaatgtcaaggctcaacagtgttgctgaggggctgctcccaaaccccacaaatctaggcctcttcttccccccagtgcccactgagcccactaagtggcgctgtcgaggtccagcaatgtgctcccatccccaggcagcagcagtgtcaaggcagccactgggaacccagtacaggtcctcactgatgcttgacaattccctggggcagctgtcctgggggatagaggctggctccgagccctcagggccagtttttccaggtggaagcagcacctcacagcctcagagccattgctcaatggacagtctggccaggctgggcactcgagggccccccactgcctcccttgcccacctgcctccctgacctttcatttgccccacgacccagctcagcaccttgcaggagctctggagcttctgctacatccctgagggcttctgtggctgccaaacagtgctgggttggttagatacctggaggagaagccccaggtgagagctggaggatgctgttagagaggccacacccccggagtgaggccagagacgggctcagagcaagaaaagctggcctttcctcctcctgctgctctgttcttcttaccaggctgtgaccacactctggcagaaagcataactatttgcgaagctgccttatcacttttaggggaactataaaattcccaaggggcccagacggggtcttattcggctcgataccccagcgtgcctagcaaagagcctgacacctacagggaactcaggatggctcaagatgaaatctagacccacacttgccccacaaaataagatgcagctgtgaatggcaggctgctcgctacatatggtccctctccacagtgtctgcctcccactttgctcacgccacagccatggtttgcatgtggggttgtctcatgaaccccaccagaaaggcaggggtaggctggagagcagacacgtggttggacgcatgcattttactgcacatgtgcatgcagacaccacttgccatgcatgcccctccaatgaacccctggggtcaggatcaggcactgggcacaggtgggaagaaagtggagccataggaggagcatcccccatccctgcccgggcaggaaaagctcctgacctgccagcctcagtcctggttatttagtccctcactaggtatctgtaatcctgatgcctcctgccttggccagaggttagtgagtgaagtctttgtcttggcctcaaaaaagtccattcagagaaggggctgaaggggaccttggagagctctgtggggccagcccgctagacccacaatcggtcgcactgctgagcccagcagtgtcgcttagatgatcagcagagccacctgcgtgtgtgcactcaccctggttgccactggccaaagggaggcctgcccaggccctcgcagtgaaatactcatgcctctgactgcagctggcaccaccctcccggaaggctccatctatggggccccttctctgaagtccagagaacagagtgattaggtgctggcgccccatgcagtgtgctgcccaaatgatgcccctctcaggcccaagcccggtaagtccctcattacgctgcatcactccaatggctctcctctgcaggctggagcttttttcagctgtggtttatataatttaatgctaaccagagttctttgagatactctgaaactgcaaacattttgtcaacgcctaatcaaaaagcaagtgctgcctccctcaaaagatgcccacatgtgaataaactagaggcctctttattgggaaatggtttttccttggctaagttctggtgacctgcttgaaggtccctgcaagtgggtggggaggaggacggaccaagggggtgtggtggggagggatatttggagccaatatcagagcccgacagacgtcatttcttctgggatcctcagtagcttagcttctagaatgttctgaagaatcagaagagggtttctcaaactttcatgtgcccaagaatcccctggggatcaaatgaaaatgcaggtgctgacttggcaggtctggaggagggtcagaggttcttcatttccaaccagctcccaggtcatgaccatgcatttgtcttaggaccagcagggaatcagcgctactctcactcctaaactagaatggaggtggggtgggggcagcacgtgcacatccccagcgtgggcccccagggggtactcagcaggtattaactgcaaaggatatgagtgaaccagaatcttcacagccgctctccggatggggtggaagggactgaggacatacaaggcgttggtggcactgaaccggaagatggtcttgcctttattcagtacgatgaaagtctggggacagacagtagcattaggcccttgtgtagaaaggcttttgggggcagcttttggctcagagcccttggactgtggctgagcggtgaggtgggaggaggaggagaggggctgagggaggagagggggaagggaggctgccagcacatttggcaggtcagtagactcactgccttgcccatgggtggaggtgagggagatctcaggggaatgtccggttggttgagatttagtttcaaaattatagtcacaaaaagaagggagcttttacagtccttgcccagctgttgtcacagcagaggctcagcagacctgggaatgcctcctccctccccttctcccttagctgacccctcctcaccctgcatggggtccctgccaggcccactgggagggagggcgtgatagggaagctgcgtcagcaggaaggacttacgggtgaggagaagggaaaacgaaaatgcagaagcagtcccctgagagagcttttcttgggaccctgtctcctggagtccaggacaaatgtcagccccatcccacaggacacagcctactgcctccctccagaggatcatgaacagtgcaatgcaacccctccctgagcttctggaagatcctttctacacagcacaatggggcacaggagcggacaatgagagccaaatgctgagacacatgcacatcaggtgcccaagcagcccttgaggacagcagtgcctccccacctgccccggtgtgtggtggtcacagctctgtggcctcacggaggtctaggggaatgtcacaacctgacattcccctgagacctccctcacctccacccatgggcaaggcagtgagtccactattctgccgaatgagctggtgggacaaggttctacccaatctggtctggggagacaagctgaccagatagattaggaccaaaagttctgttgtggtgcctccattgccttgtggggctgcaggcagcgtggccagggatcaacaagtggaaacagaaagtgagaggccggaatcatccctggagctgctgttcaagcattcccagacccaaggacagaagagatggtgtccctgatctctcacaggctcagctgccaccagcccccaaaagcccagtccagtcttgacctcaacctcagtcaggtccacctgccgtggagcctgcctgtcccagctaacttcagcctaatcgccactcatcctctccccataagcttgactcacactaccagctgtggccttaaccctaaccccaattcctacttccatctccgaccaaccatgacctaggcccgcccaccttgactaagcccaccttccagcctcattctgactccagctatggccccaacctggcctgcactccactggagtcacttgaaccaagggaaagttcagctgggggcttgggagcaggaccaagttcaaggcctcctcccccacctgtttatgtggactgggtgggcttttacttcacatgcacaaccactcacgtatccaatgcatgcatgcacacccaaagacacggcccaggctcatccccaggctcttggtcttaaaccacagtcacacactcttgtagtcacattttctcactggccacaccagccctgtctgacccccatgagcttcctcagcctggtgctgactgcagtactgtgcctggccactgtcttcctcatactcagccttctgggaaaaatacctcccccaaattcaaatccaccttcctctggaagtaaggcccagaagtgtgggtagcttggagaccaagcctctgcaggagctctgtgtgtggtggggatggggcacaaatgggcctgagatctggaggagggaggccagggcagggaatttggacaggggcagttacctcttgggtcggagccatgctaggaggaagcccaagtctccctgccctagcagacaaaagccacttcccttccctatgatcagaagggacaatggcagaacatcacacgccaccctcccccaaaaatcccccagtgatcactgccctctccatccctttcagactttccactggccttcttggtcccattgccagccctcaaagctcagggaactgctgctgtggccgtggcctgagccagccagcatagccatgcatagttcgtgggtgtggggactacatgctgtccccattaaggagaaaggaccacaggctatgctctgtggcccaaactcaggcagggcccaaacgcaggccagaacttggggcttgactccaattcacacacacaccacacaacggggaggagtccttcaggggtaaaaatctaaccacacgtaattcccaaagaaggacatcacaggaggcgtgttttccctgaggctaccctctcttcttcattacaccaaaccagcatctcaggctgcataattcctgtttttattccagaattccaaaattaaggtgattggaatatagatcaccagtgactcatttccccagagcctcatgagccaccctaaatagagccccatatggaggccaggccctcttccccctctgctccattgacaagggagttgcacagaagggtaggcagggctggaggtgggtggtagtcaccttttgggtgctatagaaggggtccaggtcctccaggggctctccgatgagctcttggggtggattgccatagagatctggcagctttttggaggcctgcaggtccagctggggccggggagcctcctcctcgggcagcccctctcggctctcctgcaaggtggttgagccgcgggcttgcttctctgccatgcgcttctcgatggctgccagggactcccgtgtgaacctgcggaagctgctggtgccccgaggtaataggaagtttgccatcttctcatcctgcttctgggcacaggctctcctcacgttgcctgtggggaagctggaagacacagacaatgggcctgattctatgcccagggacagagagcagggtgggcagacctcctgggggtggctgtgctggtggagggagggacaccatttgcagagaggctccagaccccaggatgccaacaactccacaggcacacctgggcaacactggcctgggtaaacccaaagcccccccaggctacgaggcacacatgtagacaggcagcagggtcacctcccctttcctctcctaacaagcatgtctgaattcaagcaggcaagagtgactgtgtcatccaagcaccttctttttgccccattccacacaacaggaaacacttacatcttttggtttcttaactgtcatcacttgagacatttctcagcttggagttgtcatccagatgttggcaccctagtgtacacagctgtggtggagcccctgcagagaggctcccaaggaaatccccagggtgcagaaaccttccgaaacaatctggctcaaaaaatgggcaatgcctcccttgcccatctgagctatttcccttccttggaaaggtcaaaattaccctggcactttaggtaacccgaagataactctgccttccatctcccccatcccctttaaaaatacatacatgcttacagattttgtaataaccaaataaaattctagcaataaattgaatcatactgcaaaaagaaaaatgggaagagctgatggagtatctctggctcctcacactgctccttgctcccctcctcccaaatgtgaacaaatgaatgctgatcccaagtgacagcagaaccggaaaacagtgaccactcatcagcgaggacatccagccggcacaggcatgtgatgccaaaccgggagaatgtggcccctggtggcctcaaacaatccagaacctggtgtgaacacactctgcctatgacaccgaggcagaagaatgcagtcccaactgccccaccaaaacaggatgtggtcggagcagctcctgactgtgacaccaagccgggaggctgcatcgctaatgaccacatcaaaccagggaatggtgggcacccgttcaagagggcacggtggacacctgttggacatctctgccagaacagaatcctttcccctcacgagggtcagctttgccttgatcttacttctgcaaaacatgtcaccgatgaccccaacgagctgctgccgtaccaacccctgcacatggccagcaaacggcctggactttggggccgcagccctgaaccctgaattgctgtgaagcaggcacctggccaaaagacaggtaaatagtgagcaaacacaacacactcaggcctcaaaagggcgccgctcgtccctggggaagtgtggattgagatttgtgaagggaggcaggacagaggtcccaggacccgcacgttaagaggcactctgtgtctttttcttgtttcattcaagtaaagttaaagaaacatctttgttaaaaatagcaggtgagggagtaggtttctactctataaaagcatttccctgtctcccttccatgtttgagtgaacagacatctgtaacactcatcaatgcatgtgagtgaggacttttttttcttagctcatggatatttgggtaattttaaactattttctttatacttgtcttcattgcttgaattctttaaaatcagcttgcattatttttacagaaacaataaaactcatttgtccttttattttaaaaattaaaaaaaaaaacagtctggatgacagcagcttcttacagggcaaccctctccactgtgagcaatcagttccataaattgggaagccacctcttttgcttggacttaatttctaaaaacagtgttctctgtctcactgtatccatctgtgtccatatgcctgcaagggttgtggggacacatgcacgcccatggatctgcagaggctcactggtacacactggcaagggtttgtgtgtgtgtgagagagacagagtgtgcgtgtgcgggtgcaagcttacacctgcacatacgtctgttctagtaaaggtgtgtttttaatttgtattaaataaaggattcatgcagttacatgcacataagtgtacagatggaagaatttccacaaacggaacacacctggtaaccagcacccagagagagagataaaatgctcccagtctctcagacttaggctgccctccagtcactaaataccctcctttgcccagggaatcactctcctcactgctaatggcatagaccagttttgcctgtctgtgtattaatagttcaggggcccttcttaacagactcggtgaaggggtggtggagagatttaggggagaaaccgcatctccttctcattaacctctaattcaaatttagcatttccttgaattgtgaatgtaggcaacaaagcagaaattgtgaccaaaagaaactgcagctatttccctgtcatgttacagttgctgctggcctctcaaataacattaatactcatcacgacttcaaaattatagcacttagatttgctgctagatcttaatatttaaaacatgaataaagacatatactactctatcaaaagttggtttctgtgttccgatagctgtatttcaatatagttggtttcctttttaatcctatgtgttttattttgtctcaaaatatgtgcttctgagatgggcttcgctcaactggtagagaaaggttaagaccctggcttggtccttgctcaggtgctgaccctggggtcccctcctctgcacctcagctcctcatctctaaagaaggatgaggcaagcctccaagtcctttctgggattctataatgctcttaccgtgagtggtttcagccactcccctggcctctggctctgacttacctgaactttgtgtcatttctgggtgtggattgggaccccagtctgccccacccttggacctgagaaattccattctgagtcttgcagtggccctgtgggatggacaaagaccagagaggcagatgtcctacgtccaagcacttccataccctctccagtcttctccatccaaggcctggtgaagaagccctaggtcctaagaaggatcctatcccagctggcctccagcagagcatccactcgctcggggccctggcctgggaggggtatagtctgcccaagggagctgctgaaaccagattccagatgaagctctctgctgcagcagccgggcagcctcattttccaaagtaaacctaccaagagtgtcctttgtctctggggcccccaggctgctcctggtgggcgggtgggatccgctttctcccttattctcccaccacctgcacctggctctggccctgcccttcctttagcagctcagggcccacgccctgctgtggccaagcctggctgagtcctgcctgcagggcttccggtgctgccagggtgaggagggctcaggggtggtctgaggatgctctgggctcaggttcagccacacccctcaggcctaggatgtcaggcctgcagatttcagaacccatcccctggctgtggaaggttgtaggggaaaataggtaagcaggggcccctggtgttggtctcacatagccccagagtttggggaggctggacctggcttgattgtaagaccacagtcgctcatcccctagatgctagcacctcatgattctccaccccccaccaggacagctgctccatctgcatcagcttggccatctgcagcagccctaccgcagctcatcaggctgggaccgctccatccggctatgcactcttccggggccaggcttccctgtcctttgggcttcactctagagccccacccccaactccatcctgccccaggttcatcagcttctggaactggatgcatccctccctgcatccggaaggctcctgagagctcatgatgggagcagactgtgaatcttcctttccagactggctcctcctgacaccctttcttctggcactggccacaagttcccaaccctcacccaacatcactgccctgggacaggcctccttgcccctgcttggaccatggcagtgcctccctctttccttctatcccacacatgcagccccctgctcctagatttagacattctccaaaattctgtgtgccctgagtgatgccagagtcacctcctgctctcctccccactctacctcctccaggacacctcttctgactgcccacccacccacactgactccttcctctgtgccccctcacccagctctggccccttcctggcctctgctggttactgacaggccctgtagtatgtgtattcacatcaaggtagagatgctgcacaaggagaatattaactgttcacaccagaaactagacccccctgcactgttttctcaactggctttcctgaaggagggttttctgaatgcaaaggcacatagctggtgctcaatcagcaatggtgacactgctatgacaggacacaatagccaggcaggtagagagcagctgtaggcactgtctgaagtgggagatggatgtggggggaactacttgtcccggtttacatgggactttcctcattttggcagtaaaatttctgcaccttgggataccccccagtcctggacaaatcaggttaccctggggagcctcccctctccttgcagcccctccctactcactcccctccctgatcgcaaaggaaggcacacttcaacctcctgagtcacgtctggcattttggtctccttggaatcggagcctctggaacacagcatgcaaataatattctttgccatgtaaatttatgcaaagcattgtgtggaagtggttcccaggcttcctagaaaatccctgtgggcttcctccactctgtgctcctctctcctgccctgcagttggggtgacctcgggctggagcacccagcacctagggtttgcagtctcaccaaacccagaacacagtgcagctttgcccggcgacagggcactcgccttctgcctgcccctcagtgctaaagaagaggctcaggaagagggtgtgggtgccctcaaaacaggagctcactccccataggtggaggtcaggactccctgatcacactctgatcatactccacaaatgagcacagggcccctgctctctaccctggctgacaggactccctccaaagacgagtctgggtgctcctggcctggcaagaccagggacaggagaatgggactagatgtagcttgacaagctgtaacttcaccccagtcatccacaggcccccaaatgtggagatgacagccaggaacctcgctcactccaggcttccttgcttggagtcacccatcagaacttctagccctgcttgtaaggcaactgcattttttccttgagaacatgtcaacccatcaacacctcacagactcattttattaattgaatgattcagtgaacatttaatcagcacccattgtgtacatggtcctaaaaatgactacacagaatacttttcttcccaaagtgatggatcccaaatcaacaagagataatgaggggatgaggaagagtcatcagtaaagagagtctgtggtggctggcaaggaaattcacccagatttgctgacattggcaacaagaaatgccctgagccagagaaccaggccttgcatccacctctgcctccccgcctggcctcccacctcaccctcttgaagatttcctgttcctagggataaggaagtggttagggctgtgcttggaagccagctcacctgagtgaatctgggccctggccatgcatttgtcttgtgtctttgggcagattgattgatgtttctctacctcagttttcccattcgtaaaatggggttaataataatatctattttacagggctgctgtgaaacataaatgtattgatatttgcacatgcttgacacacagaaagtgccaaatgaatttagttggtattgtggttattgttgttattattattcttatgagagatcaagctcagaaggcctccttgttgcccacaccagccctccctgcctgggctggctctttccctcctctctgtattcctgacacacttgaattcccatccttacttcagcacaggatggagtagtttacttgcacgcctgcctccctcctggatttttgtcctggtctcccaaagcagggactggtgaatgaaggaatgaaagaatgagggagtgtgagattaaccttcctcttgcctggatagacactcacactgtgacttagtcccttttctagacctcagtttttccaaccccaggcactggactaaggaccaccccagcagcatcacatgctcattctgtgccctgcactgcacttagtgcagttcgtggatcaccttacttcatccttgcaacaatcctaggaagacgggggttattagcctcgctttacagatgggaaatctgactgtaggagagatgaagtgagcccctgtctgtatgaagccaggcctgtgagcctacccattgcaccacattgcctcctacctctgcgtgcagagagtgggataaaagctcatggcttgcctatggcccatctgcctggactgtgtctgtgacccccacttcaaggctaagagtcagccctgtcagcctcatctgagcctggttctccctctatgcagcccagatgctcccagggagacctagccgatttctgcccatgcccgaagagtcagcagttttcctggcagaagcgattccccagcagtttttctctccagctcaagcactgtccaacaacagggtggccactcattcactgcatgtggctaccaagtgcttggaatgtggctactgtggactgagttgtgctattgtaaagtcacatccattttgcaggcttagtacaataaggaatgttgactatttcgttaataacttttaatattgattacaagttaaacagataatatttgatagtagtatactggattaaataaaatgtgttcaagttaatttcacgtttttttagtttaaaaaatgtggctgttagaaaatttaaaattgcatatgtggcttgcatttgtgactcatattatatttctgttggatggcactggcatcaagttccagccaccaggccctaagcccttaaaaaaattctacctgaggccgggcacagtggctcatgcctgtaatcccagcactttgggaggccggggcaggtggatcacctgaggtcaggagttcgacaccagcctggccaacatggtgaaaccccatttctactaaacatacaaaaagctagctgggcgtggtggcaggcacctgtaatcccagctaccaggaggctgaggcaggaaaattgcttgaactcgggaggcagaggttgcagtgagcggagattgcaccactgcactgcactccagcttgggcgacagagcgacactctgtctcgggcaagggtgggcgtggggaagacttctacctgctttgggggtggggctgggggcgggggcctcagggaaggattgaaagagcattgtcccccgcagaccagaaagtgcccatcctggtttctggcagtggctgtgggtggttgtggaggctcaagccacaggttgggatggtgggggatgtaagtgggagagatcgacagtaagtttcagaccatccctcccgcccaggcaattgtctgcacagtctcggctctcccgggctaacagcttggacaaaggctcagtgggggtgccagctggtgctggtggcctgtgctttcaggtccttgctcccagatcaaaggcacattggtccgtccttgcacggggcctcagctaaccagctccccacaggctccgctcctttgaggctgcataggcattaaccctgtccagtctggagcccagttctgggggagatgggagagtctgaggagcctgtcattctctactcttaatctccgcctccagcgatcttgctaagtcctgaagaatcatccccatccctcctggaggtggaggagaacacacccaccctgaagccagggaatgccctcatttacatacatttacatctcatttattccaacacccaggctgaagccgaggctaattcagctgacaggaaaaccccacccgctttagctctgctgctctgctgaagtgattccccaggcagggatgaaatgaaatgggggtgcctgagaccgggtcctcctccagaggtgggagctgaggaagagtgggctcttcggcctgagccctgaattttgcccacctcccaaggacaaactggcctgggggtagccactctcttcactgaaaggtgggtggccctgcttttttcttcatagcccttccccacagtaaggatgggggccgggggcttggcagcagcttattcaacccatcgactgttcatcagtgtctgggtgccaggccaggggaactgcaaaaggcccaggtcattcaggtaccccctccaaagtgcatagggcacccccctaccccaggcccgagtcttctttgtcagcccctttacacatgcccaggtccatccacagggtatctagaatatgctgagtggcacttcgctgtcagccaaggcagcactgcccctggccctgggtctccagggtggggacctggatggtctaataccctgaaaccacagagacccagagttggagtgccagcttagtcacccaggggcattccaccccggaccccagaccatctctgtgtaaacacacatggtatacataatcaggccagaaaggtgcccacatgtggcccaggaaacaccgtcatggcacacaggtgcccgagacagcaatcagcgttctaagtctctttctagctcaattccttccaactcatttttctcaatacttgagctgaaaaaaagcttcacagaggaactgtgcactgatgccatggcaactgaggcatttatggggcacctactgtgtgcaccaagagagatggaaacctcggaggcccacctctagggtctcttagtgtccagagggaaataagccaatcaaccaatacactaaatttatgccacaaaagtgtccatgatgtattatagccaaatgtgcaacccttttttcttaatattctttcatactgaggtactctttaaacacaagaaaatgctttaagtatacagttggatgagttttgacaaatgcatacacctgtgtgagtgccactccaataagacagcaaacatcccctcaccccagaaagtcccactattcctttcagtcaactgctctgatttctatcacctaggttggttttgcctgttctggaacttcatgcatatggaattctaccttatgggctcttctgtgtcaggctgtttttactcaacacgatgtttgagatttttaccttttatttgttggcgagtgtgatctaagctccctgtgtaatgcactgtgaatacaagtcacccatctggggacgtgtccttaatttgatcataaaaggcgaggactggaagggacctgaagtccagctatctctggggaccatagaccccaagggatccttagggagttgttatctctccttccctcggacttcctgaaacagaagctcagcaattagacatctaataggcacctaggctccgcaagcaagtgggggctttccttgggtttccagttttgctggcaactagctgtcgctttatttaactggcagtctgtgctgcatctgacccagcacagtggtgaggctgtcgctgcaaatggccggctgagctcccgtgtcttcttctgaccacgtctatgagcagaacatgaggaacagaggctggggtgggtggtctctggccctcagcctccttgtaccccacaccagctggtgtcccttgagtggagccctgggctcagtacagaatgaatgcggggctggggttcttcctaggagcatgcccagaggcagcagagctgcgcagccaagggcgggcaccttggctctgaggggcttgtctgggccactttcctgcgcttggcccaggtcgatgaggctggggctttgatggccaggcagggtgcactgattgggcttggctggtcccacccatggtctgatttttcccccatcttagatcatttggggtacctcccagccaagcctgagtgtagggggatggctaatgtagcttgagtaccctgagaactgatttggtgcctgaagccagattacctctctctgctctgccaactctttgaaagcggcctcttgccttgcacaggccttcgaggaatcaatacctaccagaacggcatttacctttctcctggtgccaggagaagcctctctcctgttcaaaatccattcccagaaaccacgggggctccctgggcaagggtaagggtgaagtcctgtctgagctctgcccacttccccgtgtgaccttgagcctatggggcagccagcaccagccttggccacccagggctgttaggaggccaaggaaagcccttggtgatgatgacaggggtttctgagtggacaagagaccctcctgggcacacagagatgctgcgagagcagctccatccctccactctgctaatacctctgtggggacatgactttccattgcctccctaggagatttaaacagaagaagaaactgaagaggagagaaagaactgaagcctcagtgcatagacattctctcctgacaacaggcccagtcacatgatctgggcattcacctctctgaattctgtgcatcctctgtggaggggtaccagtcccacctgttccaggcagtctcgcctggctgctctgggccacaatgacctcccaccagggaagctcagcccctaagttcaaccttacattcttcctgtcctgggcggatctctccctggccctctgaggcgaacctaggaggtcttaagaattttcactgtccttttctgcccctccagaatagtaaacagagtgaggaatggacaagagaggttgagaaactgttctatcagactctggcttcgcaaatcacaactaaattttatgttggacttggggcataccaggtaccccttggggaaatgaagttgcagggggaggctgtgggtaccaagctccccagcccatggctgtggctcttcagggaagacaagtgacggcaggcggggtggagaaggtaagataagtgttaaagaattgatgtcagatggcctcagtgttgtgccaggggtggtgcctacctccacaaagcctggtcctgggactgtccccacactggggctcccaggctctgagaattgatgtggggtctctataaatagcgtcattccatattgatcatcttaaaaagacacggtatgttctaggcccacggataggagagttgtgtctaaaaatagtctcatccccaggaaccgctgccagcctgaggcgagtggtgtaagctgtgcatagccgaatgggcagtctgaaggggtgggtcagaaacagaggcacagaacctctccatccctaccctattccctctgctccaacccacagagtttgcccctgcctcagggcctttgcacttgcagttccctctgtaacattctttccctagacctcctcgggcttggttctttcatgttattcaggtctcagttcagtctcctccttcaaggggctttccctgcccagccagtctagagtcacccccacgtctctccatcacattgtcctgttgtatttccttcatagcactagcccctatctcaaattatcttctgtatggattggtttaatggtatctccctacttgtatgtaaacttcataagaacaattgttatagcttgtacaccttctagaaccttccatggcccaaaggcatgaactctgcctcagacccctgcatcagggcagcctgggctggcagcaggctgtggggctctcccgtcccaggcttcccctgcagccctggccagccctgtcgtgggtctgctccccacggggcccagcctctgtccacaggctactcactggccctgctttttcctctctctgccttcttcatgtatttagccgcagggcttttactccagctcccttctcccaatcctatcaccctggatacctgccctagacaacttaatcttgtccctaaatacggctttctggaacacccttctctctgcagagcaagggctcccttccctttctgcctgccacccccagcaggaatcacatttcctgccatcaaaatctccctcccagagattcacagaaagagttattccctctacccaggccttcctgactgccccctgaacaaacagtaaccactacacacttcactggtacgatcttaactcacagacctgcagccctcactgagggaaaggccttcccccaggctcctgcatggcgatgtgctgcacggacacgcatgcccacagtgtccactccaggctctcccgacagccctccctgaccccacccctcgccagctcccttctatctctctcctccctcttcaaccatcaaactctttgaaagagctgtctatacatgctgtctccacgtcctcacctccagctcgcttctcaacccactccaaactggcttccattcccaccaagtcactcattcattcattcaacaagaacctgtctgtactgggccctacattctgcgggcgctgagtggagtttctcctaccaaggtcaccagcaccctcaccatggctcgatctaatggacacttctttttaaattattcattctttttctatctatccatgaacttctgagaatgcaccttaagtctctcagcagaaagaaacagggcactttccctccccccgagcagggcactctccttgccttctgcagcgcctcctactcctggctttcctcctacctctctggctgctccttttcagccttctctgcagacttctcctgctttgatggttggagtatttctgggctcctgactcagcccccttccttcttaccctctacaccacgttagaatcacctgggtgcttccaaaactcccgatgcccaggcctcatcccagggtcaaatgaattagcatgtctagggctggagcctgagcataggtatttttacttaaagctttccaagtgatgctaatgtcaccaggagtgagaaccccaggtctgcactctcgctgggcaatctaactcagtgccacatctccaatgaccaacctctgctgaaagctctaagtttccatttccagcccagatctccatcctgaacatacttcctacctggacccttccctccaactaccttctggatgtcagcatctgtccctggaagtacaacaggttcaaatcagaaccatgaaacatctgtcacttttcctttgctcttcatcaagcttgccaacccaaatttaacttgcccattcttcttctcatggtgcgccagggggcagcacacctcacttagtgagacattggaggtggggaatgggagagcagcatgtcacttgacagagaaggaagatgggacaccataagttctattacctgtggtaagctgccagtcgcctctccttcaatggaaagactttgcatggcacccatggtctgagctggggaggtggtatagtacacagcagatattgacacttgggctcaaacccaagttctgctacttagaaaatgtgacggtgtgcaactatttaacctttctggaccaccagtttcaccatctgcaaaacggccattatgatggtccctacctctagggttgatgcaaggattcagtgagattaaccgtataaagcgcttagtgccatgcctggcctgcagaaagcactcagtgaatgttagctatttttagtaacattactgaggataaattcccaattcctgagcagagctcacaagggcccccgtgactgtgaccttggctttaactccgctcttctcttcctcacaccatggggcccaacgaatcactcaactaataattgtgctgtttcacttttctgtcttttgtacatactggtcctgacagctagactgcactgtccttgcctggaaaactcctattcacccttcaaaacccagtgtggaaggttatttttgttagaataagattcttgactattccggccaaaggtaaccacctctcctgtgaatgggctctggggacacacttctaccactgcacacccttccaataaccttcccaagagtgagcataagccagcctcctctgaacagaacacaaactgcaatttgccactgtccctggctgccctcaggactcccttctctttggattgcctgggcaccagcctccgctcttctcccatccccagctgtctctggtgcttcccactagtcctccaagcccaatcttcatgctgagtgagtcaatactagaatttttccagaggagctttgatcaacacacagagagggagccgagcaccttggagcacagcagctgcccttgccacattgggctgaatgctggctcttggcaccccagggccagttccccttctgctcagatcctcctggctcagttctaggcttatttgccccacagaaagtagatctcaaggtgtcttcacattgcgtggtgcccccaatccactgattctctagatgacattgaataagtccttgagctcctctgggcctcagtttccccacttgtatgatatggtagtgatgacatgattaaaagtttaatgaggctcttttcagcacagagctggacactgtaacatagaatctgtgttccacaccctggctgtcacctgacctcaccctctccatgctcctgcaacagcagcctgaccaccctcattccacctcgcactcattaccaccgattcatatgcacctgcccaattctaactgagtggagatgaggtcaaacagatggagttgagggcagcggcaatggcctgggcccccagtagctggggcctctgctgctcacggtcccactagatcctgaaggatggtgggaacctgggagagggcttgggatgccatggcatggtgggggtcacgtggtttgccatctggatgatactgcctaggctcactgggagacacacctggggtctcagcaggaggcgagcagatgcctgggaatggaacataggcccaggaccttaagaggagatagatcccatggcccggggctgggctgaaggcactgaggagcacaagagtgagtcctgcactatcttagccatggcatcctgatctggctgtgctctgctctccaacaggtgtttgcaaggcaggcctacagccagggacttgtccccaacatcatttccccccatcctcatcaccaccactaacagtccccacacctctggcccccaccagctcttggcctctcggacaaagcttggcacctccactttcttccagagcgccaccaaagacgatcaaataacacagaggtcgagagccacctcccatcagggtgcgtggatctgttccggctcagagagaggagggcagagaactctctccaatctcaccgcaaagagatctccaccccttcgagaagcacagagatcagacagaggagatgcggcccctttagggcgtcaaagggcaccgagatctctacatggtctaaacgcgcagagatctcgtcccacagagaggacagccccagcggacggttccccctgggcccagagaaagggggtgcgtggcttcctcccccatatccagccctgctcggtcagcccccgcaaaccccgctctctggaaccacattcatggcgcgcctagtcgccgctctgaccttggggtctccggcctccggtatccgggtcccaatcccagaccctccccgagcctgcgccagggatggccgggaagctggggccgcagctccccctcccccggccctcgacagcgcaccgggaaacccggaaggaaagggaagggaaggggggcgcacggtgtttagagacgtctcccccggggataccctccagccgggcggatctgcgccccttctccccctccggctctctggggcactgatcggggagggagcggctgggcggacccggggcagggaggagcacgcagggactggaggcttcggccctcggggaggaaagttgggcggcggcaggcggagggggctccggccgggccagggctgccgggcgcgggggcactcgctcacctgctggtcccccggccgggccccggggtgggcggctgctgcttggcgcggactcggctcggcgcggggctcggggcactgggcgcaggctcagcggccccgggggagcgatccctgcatcctacgggcgccgccgccgtctcggctccgcggctctgttcgggctcccgggctgggcaggcggcgcgggctcgggctgggggcggggtcgggggcggggtcggggcgggccccgcctgggttcggcctggggcttggggccccgggctggctccgccccagagcgacgcgcccagggctccgcacgtggtgctccgcccgctcggaggggggacacaccagcgcccgccggggcgcacactcccacactgacccgggggctcacagccacagacagccgcacacgcggccgcggacagacagacataggcgggggtacacacacggcgacccggcgacgcttcaccacagatggccacccacgcggacgcggacaggctcacattaacaaacactggcatacacaccagcacccgccagagtatacacacacacacacgcaaccttgctgacttgggaaggctaccagacacccacccacccacgtggacacgggcatacactgacactcatgccgagacagacacacgctgccataggcatacctgcactgacacagacacacacatgcaccctgagacagatacacacccccacacacccacacagacacagacagacacatcattgacacacactgacactgaggaagacactctgacaaacttagacacccacatgacttagacacacatccactgacacactgacacagagacacacacactcactcgaaccacactttcctggagacacacttagtgatgccacagaaatctgcacaatggtacacatctacctgaacacacggacgcacatgctgacagaaccaaacacacacccagacccagaagcaagcaggcaaccaacacagagacacccacacacgcgcgcgcgcaaacacacacacacacatacatatatatacatgtatatacctctttatatatatacttccaccctcttgagccacatacaaccttcaccttgacacatgcagagcctggagtcacatacttacacacccactgtttctcactcagagacatggtcacaggcacacacacacggagacatacgctgacaaacagttgctcccatgcccatgcccaggacctatggggacacacttcttgtttaaacaaaacaggccatcagggcaacccgcttgggtccccttccacgctgtggaagctttgttctttccctcttcacaataaatcttgcgcttctaaaaacaaaaacaaaaacaaaacaaaacaacaacaaaaaacaggccatcagcttttgcccacgaaaaaagtacagtcattggaagggatggtacacttttctgccacattttcagggctcccaaaagcaagaaccgctcttagagagccaaatgggtgccagggtctcagagggcacagaggtgctgggtttgggagcccagaggctgggacctgctcctccatgatggggatcttgaagaggtgggagggcaaagaggggggtgggggacagcgtccgtttgcgacctgggtgtggggcttcgttggacgccttaggtacatacggaggggctgctctgcttgcaggaggggatcagtaggaaagtcagtccacaggaaagttcaggacatgggcctctccggccccgagttgagtggggtgtctggggtacagacggatggaccacacaggtcggctgccagcctttagcgcctgacgagcctcaggttggctagcagctcccactatcggccagaaggggaagtgcaggcagtgtcaacgtttcaacccacgtgcagccgccttcccagagtcacacctaccaggcaggagagtacagtagcaggaaggtcctacctcccctaagaacttccatcacgggcttctcggcctcagaatgaagcttctacttgcaaactgacattgggtcaagcaggagacaaggctaggatagaagctgctgggagtaggggtggatacctgcctcccttccgtccatatgtagcagaagtggggttttcactctcctgtttagtattgggcaactggatgttgccagcaggagaggtgggctgagcctggtaagtctacatgcaccctgaatttaaacagggggagagaagcccaggggatggggaaccagagctctgaacctgtagaagttcatccataaaagcacaccttgtggtcctagagaggcctcagagtgcagagacaggcaacaggtgtctggagacaggcacttcctacaaagagcccttgccaagatcttggctactcccttctctttgccagaccctatttaaattttttgttttgttttgttttgttttgtttgagacggagtcttgcattgcctccagggctgaagtgcagtggcgtgatctcggctcactgcaacctccgcctccccagttcaagcaatcctcctgcctcagcctcctgagtctctgggattgcaggtgctcgtcaccatgcccagctaattttttgtatttttagtagagacggggtttcaccatgttggccaggctggtctcgaactcctgacctcgtgatttacccacctcggcctcccaaagtgctgggattacaggcgtgagccaccatgtctggccaaccctatttaattaaagcaataacaggaacatgttgtcagctgtcagagataaatgtttttaaaaactagtatgtcctttattcgcccctcagtttcgcccagggtttgcctttactttgcctcaggttcaaagctgggttaaccatatcattactcctctcttgtgtttttgttttatttcttcccccatcatcactccactgccatctccttctccacacaggcacccctctaggagctaaagtaggtctttatgtgcacatccttgtaaaacaggtagtattgttgtttgtgcatatgcattttctcttctaacagcccaaagcttttctttttatgttttacttccattgaacctacataatggaaaactgcacaaatcctaagtgttcacttgaaagggttttctgttgttgaacacatccgtgtgagcagcacaacacagaaaccaaacgttatcagtaccacagaagacctctttgtgcccctttctgtcaccaccgctacacccacccagagttaactactacagtcacatcgaattccccttgctagttttgcctggttttgatatttatttaaactggaattgtataataggagctcttttgtgtctggcttcttttgatcagctttacgctcatgagagtcacatgttgctgcttgttgttgtagttcattcattcttgttgctgtacagcatcctattgtatgcatataccagactttacccattctactgctgatgggtgtttgggtagtttctagtttggggttcatgagtagcacacctatgaacattctagtacataaattttgatgaacatatgtacccatttctgccaggtacatatttgggagtggaattgctgagtcataggataatgtgtgttcgcttttagcagatgttgccagacagttttccacagtggttccaccagtattcactccaccagcagtgaatgcatgcatcctttaacacttaatacttttgtcattttcattttatctccttcagtgggtgtgcagaggtttcatattctggttttaattggcatttccctgatgactaatgaaattgagcacattttttatgattaatggctgttggtgtgtatgtgcttttcatttatataaatgggtatcgttctagatttccttcttttccttatgtttctccctcaacaccctgcttttgagctgtatctgtgttgtggtgtaggcagctggctctttgcttctgatagctgcagaatgttctgtgttctgcatccacagcactttattaatccattccccttgaggtgagagattgaagaaggtaaatggctggaagagtagtaactgtcttgtgtttctgttttcttcactgtgctaattccaggggtggaggtggacaaagaagcaagtggggtctcggatccataaacagtcaggaccaggaggcatcttagatggtggaggtgcaggttggggctgagaacaggaggcctgggggaaaggccacacaaaagccagcagacccagaaacgccttgcccagccctccccagcagaggctggtcctgcctcatgcagatggctatctgtgagctctagatggagggcatctggcacagtggaggcaggcttgaggagccttactgaaagtaagagggtctagtgagaaccctggtttcctccttctgctgggcgctggaactctgactcttatgtgcacttcccactaggcagggggctggggaatttcacattgagacactgaccagcccaagagaaaacatctctgatactgggcactgacattaccatctatactgcccacttgtcaagaaactctgcctgctccgcattcatccccacccctctttctccttgcctgcctcttccatgaaggctgtaagaggcaaacagtatttgcctttccagtttttcctatacccagtggcggccatgtaacttaatgagggccaagggtcagaagcaaacttctgctagggaagggcagtttctgagagagcatttgttttcctggtaaaagaggacaagagctgctggctctactgtcttcctcttcttgattctccctgccttgaatgaggacataatgcttggcgcttacaaaacctctctcagccttgaaggtaaggctgggagatttgcagaaacattggccttgatgacagtgaaccatagaactaatacctttgtacttctctttcatgctcttttttttgagacgagtcttgctctgtcgcccaggctggagtgcagtggcgcgatctcggctcactgcaacctctgcctcccaggttcaagcaattctcctgcctcagtctcctgagtagctgggattacaggcacgtgccaccatgcccagctaatttttggatttttagtaaagacagggtttagtgtgttggccaggctggtctctaactcctgacctcgtgatccaactgcctcagcctcccaaagtgctgggattacaggcgtgagccaccgcgcctggccttctctttcactctttgtttaaacaaataagacaggattctctgccacccgcagccagattgtgttgggtgaggaggggcctggtagctcagttactccaaatacaaactatttactagctctggtgtttttaacctcactcttcctccccatttttgaaggtacccaatgcctggagtcctgagaactttccagggttttgaagagagtggctatcccttgctttcttttgccagctttccctctgcagacacactctgctctggcagttatggctcaaacttgcaggaagttgtcatcatatccgctgttggcccctcttctgtacattttgtccttttacaattatttcactgtcggctggggactgtggctcatgcttgtaatcccagcactttgggaggccgaggcgggcggatcacctgaggtcaggagttcgagaccagcctagccaatatggtgaaacccgtctctactaaaaatacaaaaattagccaggtgtggtggtaggtgcctggaatcccagctactcgggaagctgaggcaggacaatcacttgaatctgggaggcagaagttgcagtgagccgagatcgtgccactgcactccagcctgggtgacagaatgagactctgtctcaaaacaaacaaacaaaaaaaaattatttcactgtcattttagtgacgtttcaatagatgtcttccactatattttgaagaaagtcctccatttcagtttctaccccaggtatttttaagtagtaatcagatactaccctcatgggttgtgagcattcttgctttattttgaaggcatgagcagttgagaccctctatcttagaaggggcagagaaaaaaaataaatgtattcatggtcaaggccatgatctgctgccaaagggctggtgacccaatcctgcctttatacctagacaatggacagggtaatgctcttaattgagggaccattcccatgtgggaagcacctgctgtctcttacatgtaccctcagcccaagtcagacacacatgccctcgcctctgccagtggccccactagctcaaataatgcctgcctgcaaatctgcaaatgaggatgagccgccccttcctcaagacacttgactgccatctgctggaaagttgagagaaaatagaaatctctgatgagtaggaatgtgcatcgtactccaggttgtgtgaagcatgacggtgcatggcatcggcccctgcctccacccgtctcatctccttgctacaaaatgcagtccctcacccatcagctctggccattgtagtgactagggagcagggcttggagggccagaagccttgataggattcttcacttatagcccatgtgaccttgtattaaacacataacgcttctgggtcttactttactcatatataaaatgagataattctatacttacctagctgagttgttaagaggagcaaatgaaatagtatgggaagatgttttaaaaataaatattttacagattgaatttgacagtcatactatctaaagcctattcatcctttgcttttgattgggctccctaaaaaccctaaaaacagactctaaaatggagatttgcactcaggaagtttctttggagttcacttgaaaataatatttgtaaggatgtgagggaagcaggattgggcagaggaagttgaactctaatgtggttgcaaccaacgcctcagccaagcctcctggaagctgggatgaccaggagttggggtgaccccttggagttgtcccaattttaggccagagaggtatgagcaagcttgtctacctccacttcaaccagtcattggcagtggcctgcttctgatgagaggccataaccttgggtgagcagctcccatgaggcaagggcaatgtccagagaggggcacatctgagagccatcaacagccacgctcctggcagctggaggaacaacctccagctggaggaggagctagagggaggaattccatcctaagaggggctctgggcaactcactgcagcatgctctcttcccttggttgtacatgtggagtgaggggtgttgttggtgcacgcaatatggaagccataagaaaaagagccaaccattgattctatacattatacagccttcccaggtctgagctttgtagggtaagaagcaccagactgttgtggccggggagggggggtctcctgggcattatccctttcactcagctggcctttctggcagctgaatctgctccaagcatattctattcaaagcatattctcaagtccacatggggtgatctgcttccccatgttccattgcattccactggggacatgtgatcaccctgagttctgccaccttcataaaggtgcaatggttgtcctgtgttttgtcatacttcacatcagtgcagtggtgtagttatgtaagagggtcagggtgagagatttagaggctgcagatccagaatcctggtgcctgaattcatcccacagatgtatttttgggggcagggagaatggtgtgcaggtaaagtgtgtcaaatagtttatagcaatgtgaatatctttgtctgagacatgcactcaccgggtccttttgatccccaccattccgtgttgtgttatgtttattaaattacctgcctggctctgccggcatttgcgattttctctcttggattaggaccaagcagcaccaagaggactgtggagcacccagtgtggccacaggaactaggcttagaaggaggtgggtaggctctgggcaggctgcatgctgtaatgagcaagcaggcagggacaggaatggggctgagggtggaggggagggtgacgttggttacagaggagctagtgagctgtgttcagagctggagactctcactggatgggaactgtggttgggcattgggtttccaccagagttttatttttatacatttgagaagcatttttattgatacacacacacaacatggattaatcttaaattgttgtgttaggtgaaagaaatcagcctcaaaacgttttgtagatgttatgaattcatttatatggcattttggggaaggcaaaattaaaggaacaagaagcatcagtggccgtggtggctgggggtggagggaggtgtgggctgactacagaggggcggagtgagggagggagcattttagggtggtgggctgttctgtatcttgactgtgatagtggttccatgactctgcatttgtcaaaactcacagaactggacaccaaaaggaatgaatttccctgaatgtaaattaaaatataaataaataaatggtttaaaaaacaagaaaggaggcatttttacctttgtgagcggaagtggtgcttccttcaggaatgtgtgagtgtgtgggtgtgtgtggagtggaggagagacaggaggtatctctggctgttagagagatggtagtcagagctgccgttctggaacagtccctggatttcaggtatttcacctctgctgctctgtacataagcctggtctaggggctctggttgcccagaaacaggagtttggactttgaaacaaaaggctgtgttttgttttgttgatcagatgttttctccctaaagcactcttcactctctctttggtggtagagaagagggagggagctggtgagtgagggagccagtgatcccacgatgggggcactcctgagcctccccctcagttccgttccttccccagcatccagatttctaaaaataaaaacatcagggatttggaaagaggactggagtcccagtactgcataggttagctgagaggctgccccaggcctcagtttccccatctctaggagcaaaactgtgggattctgaaatcctccagttaccccacctcactcagcaagaatgctgtcataatgaatgaagaaggcacacaaggagcaactcagcctctcctgctgccattcccctgcctggggctacctccttcacttctgcatccaaatgctaacaggagtcctgggtgtcccagcctaccccgtgctgcctgcacactcctgagattagtgaatgaacaaaggtgttagacctgacaagaggattcaggagactttggttcttttttttttttttttttttttttttactggaagtcaatgcttcgggccagaaaatgcttagacctggcagcggctgacaaaagctgcctcttgtcagcaagtgtatcagcttctgaaagagataagaggcagggggctggagtgcaggcttctcaagtgaacgctgacaggagaacagaagagctgcctcccactctcatcagcacggagatccgggctgccagggcggagacatcaaccactccagcccccacactgctctgatgaggggagacaggtctgggcaccgacagtgacctgcccagggcccgcaagcagcagcggctgttgctggggtccctggggaaagtctggggacctgtccgcctaaatgcgcactgggaagagtggagctgctctggacttagctgtggaatggaggcagccttgtaatttctgagcgctgtggagaacagaatccatgtggctcccattctgagaaaggagtgttggaggcccaatcagccacaactcccagggaggttggcttcagcctgggccaacttcgggaccacttccttactgatggacctttccatgggaacagggtgaacacagggcttgatgtttgttcttttggaagattctactgaatagctctcattcatttccagggtccagaccttagctgtaatgccttttagggccccacctgggatgctctagataaacatccaatagaaatgccttttcctatggttgttgtcaagcctctaggggtggacagcagggagaggccctccgttttcctcctggctcatgtgcctggtctatacctgttggatcacactgagaagcaaaattgaactgtttaatgcttctgaggctgagtggatgggacactcagcctcaacttcaacatccttctagtgcacctttctgtacccaagccagaaggctagcaagtagatttcccagactcctttgcagacagagttctggatttaaatttagattccaccaattagatgtgctggcatgagatttgaatagcagtttaaagcagaaatcatcttcctactgttttggctgtttctcctggcaagcatagtagagatgttgggcttttctatatcagtattccagtgacctgtgactagatttatgagtataaaaaaataatatgtagcaagtgtaatggctttcttatcatggtgaattctcccttcattttttgaagcactctcttggaagtcaaacatcatgtagaaagtctgatcaccatgctgtgaggaagctcaggactgccataggtagagagatagtccatgtgaaagagcgatgagatgccaagatcggagtaaagcattcttggatattctagctcatcctaaccaacagctgaattcagctgagtgaatgaccctggctattgccacatgcagaaaaagaaccactcagctgagcctgcccaggttcctaacacacaaacttatgagcaaattagaaggtgttttttgttagtttgtttttgttttgtttttttttgagacagagtcttgctctgccaccccggctggagtgcaatggtgcgatctcggctcactgcaacctccacctcccggattcaagcaattctcctgcctcagccttccaagtagctgggattacaggcacccgccaccatgcctggctaatttttttttttgtatttttagtagagatggggtttcactatgttggccaggctggtctcaaactcctgacctcaggtgatccacccgccttggcctcccagggtgctgggattaccagtgtgagccaccgtgccctgcctagaaggtaagtttttaaagcccattaaattttgggatagattgttgcatctcaatagacaactaaaacactgatcgttggattaaagctgttataattattacgtttttaaatggagacataatttacatggggtaatgtttaaagtgtacaacttggtaaattttgacatatgtatacatccataaaattgttaccacaattaagatagtgaacatatacattacctccaatagtttcttgtgccccttgcaatccttccctcttgtcccttcctgtatacccacctcctcacccctgtcaccagggaaccactgatctactgcccttgctttctgatactacaaattagtttgtatttgtctggagttttcaataatgggataattattattataatttttcatctggctcttttaagcataattatcttgagattcattcctgtcattttatgtattgatagttcattcttttttattgctgagtagtatttcattgtatggttgtgtcacaatttgtttactcattcaactgctgatggacatttgggttgtttctagttttagctctcataaataaagcttccatgaacatggaacatggtgcttccaaagcaccatgataagaaagccattacacttgctacatattcacatgcaaatctttgtatgaacataggctttcatttctgttgggtaaatatcaaggagtgaaatggctggattgtacagtagaggaatgtgtaaatttttgagaaatcataaaactattttctaaagtggttacaccattcccaccagctgtggcaagttccacttcctccattacctccccaaaacttggtctggtctggtcagttttttaaaagtttagctaagtgtttaatagtatatcattgtgattttaatttgcactttcctaatgacggatgatgttgagcatctttttgtgtgcctgtttattatcctggtatctactttttgaagtgtctgttcaaattttttgcccattttaatattagattgttatttgcttattattgagttttgagagttctttatatattctgaatcatttatcaaatttgtgtttgcaattttttcccagtatgtggcttatctttcttttttttttttttttacaatgtcatggacttctggtttcaaaatggcagcataagttcaagctagcttcactgtcctccccacaacagaaaaccaaacccaaattatacagtgctaggattatcaccagcaatatcccagagctcagatatgagaatgagtcaattcctggggccacaaagaagtgaaaagactccaagcagacagtagtagaaccagattttcatatctgcaatgcccctttccccaagctgccgagcagcaagcatgcaaaattccaccccctcctaactcataattttttttttttgagagagtcttactctgtcacccaggcttgagtgcagtggcacgatcttggcttgttgtaacctctgcctcctgggttcaagtgattttcatgcctcagcctcctgagtagcagggactacaggtgcagaccttgataatttttgtatttttagtagagacggggtttcaccatgtttgccaggctggtctcaaactcctgacctcaagtgatccacccaccttggcctcccaaagtgctgggattacaggtgccaaatcagtttctacattgggaaaagtgatactaacgtgggtaaccagcttccccactttctagattccctggcaggagctctgtccatgcctcaacccacaggaagtagcatgagtgcctaaaggtgacatattcctgaggacagcaagagacaaagtggggaggcaggattatcacccctggctctagaaaatttgctttgtaacttagccgaaggagatggcaaatgggagtggttgttcagcagcaacacactgtaggaggtacattccacaggtcctctgggcacagaccgcttgtcagcttttccacattgctgaatatcgcctttggagcctcttcctgactggcagctctctgattacttgctagagctgaggcaatcctgggcttaaggtgccatctagtgccaaaaaggaggcagtgacctagtagaaaaaaagaaattcaacaggtagattatgaagaatgtctaagtaaatatacccaataagaacgaaagcaagtcatacagagaatactggagtaagttactaatccttcaatgtgaaaacagttgtatacagggaactatgacctctgcaaatggacaaagcaaagaaacagtgactgaccctaatgagacagtgatatgtgagctctctgaccaagaattcaaaatagcaattttaaagaaacatagtggtcatcaagataacacagaaaaagaattc

SEQ ID NO: 4 - DNA, 14695 bp, Homo sapiens
  misc_feature: KCNE1 gene
  misc_feature (6677)..(6776): n is a, c, g, or t
  misc_feature (9887)..(9986): n is a, c, g, or t
tgcctgccaccatgcctggctaattttttgtaattttagtagagacagggtttcaccacattagccaggatggtctcgatctcctgacctcgtgatccgcccgcctcggcctctcccaaagtgctgggattacaggcgtgagccaccacgcctggcccctttttcaacttttattttaggttcaggagtacatgtgcaggttcattattggggtaaacttgtgtcatgggggtttgttgtacagattatttcgtcacccaggtactaaacctagtacccagtagttatttttttctgatcctctttctcctcccaccctccactctcaagtagccactgtgtctgtcaatcatccttcttgataaactcaaagtcaaacgagtccagatcttacctacatctgcaaaatcaatttttcctataaaggaacgtaatcacagaagcactgtcccacagtagtacgagtgctgagccgttgtaggcagagagggttgtcctgcccacactcaaggggagagagtgcagggccagttcacccctcacgcggaagtggcagtgctgggggctcacttcgtgctctgctcaccacaactccaaactcacaactttattcccaccaatcccatcccctccagtccagggggcacacactccagcaggacttcagctgagcccagggaacgctttgctgactggtgatgagggacctacctcttcacacccatgacacccacccgctgagcccctcaccggggctccgaaggccctggtcaggtcacctctggtctcactttccattctcccctccttcctcccctccagccacagggtccttctcgatgtgcccagacatggtgggtgcacacttgtctgacagcctctcttcttttccctttgcttggaatgctctcttcccagttaccaaagatactcaggctctctccccaatttccttcaggcccttgctccaaaagctccttccgggtgaagcctcccctcccatcctccttaaagcttcagcctctacctgggacacttcctcccccactgcctgcctccttgaaactctccttagtcctcttgcagcccacacagctgaacacaggcaggagggggcgctgctgccctggctggtgtgcagccaccagaggctgaagctcactgacgtctgtctggggcccaggatcaccttccttgattccagctctctcaggctgtcaggacctggcgctgggaggcactaggccatgccctggcctgaggccttctctctccctctttgccctgtgtctctgcagggaagcccggccctgcccctgggagggtgggggcagacgtgtggagagtgggtgtacaaggccagggtttgccaggcccaggacagcctggcacctgtcaatggatgagcgcctctcccttagcctgatgtcagggtgggcatgagggtgggagcagagggtgcctaactgaggaaagggtctgtgcaacccccttctcctaccagttctcgtttctgaagtctcctcaagcacactgcggtgtccacaccattggcagcaggctccttctcttcaggtggtcttaggaacttctcagaactttttgagttatccttctggtctcttcctcctgagcacggttctcctggttgagctccaggccatgccattcaacgccctccaggacaggccgaagggcttgtctgtttggtggttgctaaggtttgaaaaaagccagctggaaacttaatccccaaagcaacagtgttgggaggtgggacctaatgggaggtgtttagtcatgagggctccacccttatgaatggattctctctctcttgttctctctctctctcttcccgccccgcccacccctccttccccaaccttgtgataccttccaccatgtcatggcaagaaggcccttgccagatgtggcccctccatcctgggttcccagtctccagaaccatgagccaaatgcatttctgtctgttacaaattatgtacggtgtggttttctgtgatgaacacagtgctgtaccagggccctcttgccaagacagccagcttataggagcctgcatgtgaggcccggacgtcctacagagcagcagttagaggtctggccttctggataggcactgccctgccctgcacacaggaccttggtggggcatgatggggctcttcaccacgctgccctcattttaggaggtgggcaaccctttctcccccttctccatgtgcttctgcagttggaagaagtgaggggggttcagacacacttaagctgagcttagagcaaagcatgtccctcaaggtgaccttgccgcatggcctgaacctagaattcccctgaccagggtggacagccatcaccatgggcctttctgcctggcctagtatggctctccttcgaactcacctagacccttgcatcaaaggactcggggactctgctgcagtcatcctagcacggtcgagaggagtaggaaggtgcccagcggctcagcctttaaggaggtctattggtcaccattgcttctgccttcttgagaaccatcaccctcggaggatccggtagtgtatcccagtcaagtgtcaaatgcgttgttccctggagaggaaggcttatttccagaaagtactctgacgttttgtaatttgtgatttctatcactggctcagtggcctacccactgctcagctcatgtggcatgaccaggctggggcgtcgggtcatcttgttctctgggtgtgtggcaacactggtttatggcgtaatttccttcctgagaagaaattcagtaatttctaatattcagggctttaggtagaggcctgaaaatcactctccatgcctctttcagtattttatatatagttgtctcttggtatccatggggtttggttccagaatcccctgcagataccaaaatttgcgaatgttcaagtcctttatatatagtggcatagtatttgcatataacctatgcatatcagccaatcatagatggtgatttaaatcatctcttgattacttctaacacctaatactatgtaaatgctttgtaagtagttgttacctggcatttttttatttgttttatttttgttgttgtttcattaattttattttatttttggaatattttcagtccattgttggttgaatccacagatgcagaagccttagacacagagggccgaccacacctatgtatgctgttcttaaagtagcaacatatttgttctgaacatagaagaaattagtcgtctattagactttaagggagtaaatatggtccaagttgatttttaaatttagcaaatagtcatagacatatcagtgtcttacagaaaatatttattggaatgctcactctctcatttgggatactgctttgccttgctgtgtcttaagaatgtcatcagagcatcacacacttgaaaaacgtttttaaaaggatatgatgataattaagaccttctccccaacccctgcccattatccaagatcaatgtttttttcctttatcctgattttaaaatcaagtacactttattgaggcatactttacatgaagcaaaatgtaccctttctaaatatgataagtttgatgagttttcaacagatgtatacagctgttaccatgactgtgtctttacccaggttcttgcattgctcaatccagatacagaatgtctccatcaccctgacaagttcctttgtgccgcaccctctagccaatcatctgttttgaggagagttttaaaacaaaggtttttgttctttttcactgatgaccataacctaccacagacagggtctctctctctctctctctctctttttccctgttcttgcgccagctgcctgacaatttgtgggattaaagctctaagctgcttactggctcttctgactagggagagggagcaagcctcattatttttctattcttttcagtgactgctcactcctcttcctccaaaatccctatccatccatccatccatccatccatccatccatccatccatccatccaactttccatctacccatctatccttccatctatccaatccacttgcgtgttgaacgtctactatgagccattggctaccaggaatcccacttccacccaaattatgtttcaacagggaagacaaacaatttaacaattacgataaaaaagaaaatatgccatacaatggaaaagaagggggcatgatgggagacccagcgggagtagctggcaacgattcttagggggaagagacattcctaatagacacctgcaggagaaatattaaagagtcaatcatttcagtagcgcttattgtgaccaataatgcaagaagtttctgggttcccaggctgatgggtttgaaagtcactgcatcatgaatgtgcccaggacccacacgttgttttgtaagagaggggttcagtaaaatgtgaaatgaccgacattcaacaggcagaactgtgcagaatgcacgctttgccactgattgaaagtgtttcttcagtaggttttgatagaatatattactaatctggtaagaaacagcttagggccactcaagaaaagaaaagcagcccctagaaacatgttctgtggctgggcacagaggtagctgctggaatttgaacaggggtgagcaggacctcgtggacctcattgtggggttagcagggctgggctgggacaatgagatcattttctaggcagagaaaagacaacatggtaagttaaaaacactgaaaagtctgcgctgccagagtacaaatgtcagccaggagggccctgacactcttgaaagagggatttgagcagtggccactgcatctacttggcactcgttcgctgtgtagaagggtcaccgagtccctcatcagaatcctgaaagaaggagaaacggtgggcacaggcagcacacctcaatcacttgtgaataatttccttctgtctttcataaacatagctatgattgaaatgacctttcacgaacagcagggaaggattgtggaagaaaatgaggtatgtgagaagcaaatccatctacctgattgccatgtaactttcggtgagtcacggagtgagaatttcagatgtgaattaaggattgccaagagtggtgatatacttgaaaagtttcctccacgttctactccctgttctactttagaatcaggaggccagagaggcaggagggaagagtacttgttattcatagtggaccttcttcctgaataatttttagggtaattatgtatgcagcttccacctgagtcactgacctttgggtgaatgttactggatatgtacctatgatacccaggcaaactttctgcgggttctacgggcactgtgaagtgtgacagactttggctgcgcgttcacttttgatcataacacgtccatagagtgcttttaatctcctgcaacttaacatatgagaaaatcgatttattttgtagtgagttctgcacatttcacagaaaattaaagctctctgaaaacccaaatcttctgtgggcagtaattcacacacaatattctggaaatgtaaaatcccaaatgcctgctgacttcaaatcaatgtttatagcttgtgtctgaatagctccatgaattgctccgctcctctccttctactgcccttcgctttgatttagccactcatttccaggggctgattttctttttttgcatggccctaagctgtttcccatcagattagtaacatattctatcaaagcctattgaagaaacactttcaatcaatggcaaagtgtgcatcctgcatgatgctgcctgttgaatgtcggttgtttcacatttgactgaacccctctcctacaaagcaatgcgtgggtcctgggcacattcatgattcaattactttcaggcccatcagcctgggaaccagaaactttgtgcattattggttttacaatttcagctgaggcttccacagaacaactcagaagaaataggctgtcctgagtgagccttttccttgacttgtattttctattctaaggtctattggcttcactggcagtgggaccactgactttttccctcctttatctaaggggacctgttgagagtctctatttggaaatatttcctgcctgtccttagtgggggtcaatgcctgaatctgtccaataatcagatttgaccaacttggtggaagtgtggattttccagcacgattaaaccttgaacatatatggcttgaaaatgtgcaaatactcttggaaatgacaggatcatggttctcaagacagagaaaaaaaagtagcatgtgaattttcatagataaacgcctaatgctaatgttgatcaggattaatgtcatttcctagatttcagcaaataaacactgggttacttaggcctttgtgggcttcccaggaaggtcaccaccatttgaaatgagactttcaggggaaaagctgccagagattaaacagaaggcttacagatgcatcttctgaagataacttagtatcttccatggacatcttttctaatagaaaagaaagctcttcaaatgaccaaaaccattgctgttttgtggaggtgctggtgaacaggggtttcatcacagtagcatctacctgtacaaacgaaatactcgaagttctgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatcaggagggaaggaaggactctcatcttcagcaaatgacataaatctggggagcctcagtttcctcacctgaacagtgagaatgatggaatctaccctgagtatatatcccaggtctttgtgcagcatggaatcagcccccagccttcctagctcttgctttattttattttattttagagaccaagcctcgctctgtcactcaggctggagtgcagtggcgcgatcttgacttactacaacctcctccgcctcctgggttcaagtgattctcctgcctcagcctcctaagtagttgggtttacaggtgcatgccactatgcctggttaatttttgtatttttagtagagacggggtttcaccatgttgcccaggctcaacatgcctgggctgaagcgatccacctgccttggcctcccaaagtgctaggattacaggcgtgagccaccgtgcctggcctcttgttttatgtttgctgttctcgctgtaggtgaggcattcccaccatattcccttgttaaaatcctactggcccttcaaatgccagctcatatccacactgtgtctgaccctgatccagaatcctctccccttctttgaccccttgtatatatctttcctacagtgctggtcatattctaacttctaatcatttgtagacttatctgggcattttctcccaggaggtcccaaaggacagagaccatcttgctcacctttgtccccactccagcacccagaatgtttcaataaggttttcctgaattaagtgggaagcaaagtattagattcaataccactacaatgggaaagtgagtgaataattgataaagtatactatgctctggaaatagattattgagtaatcagaggaaaacctcttgcaatgtagtatgtttttatatattaaattttatattatttatttatatttatattattaacatatttttgttattcattttgtttattaagatttactctatatatatatgtgtgtgtgtgtgcgcgtgtgtgtgtgtgtaacccaccttatttctaaaaaaaaattttggcagtcagtgactattaatagtagagcacaaactcttaacctttttttcctcccgctttcccagagtccttatcaccttctaatataataaagttttcttaactgtgatgttgattgttcaacgtttgtctttcccaccaaaatgtaagctattgcgggcagggatctttgcatgggttgttcttcattgcatcccaggccactagaacagtgtgtggcatatggcaggagtgcaataaacattcagcgaatgcaggcaggcatgcgtgaacgcatgaataataagtgttcctttcaactaccagaaagagcgaaaccacacaggagctgtctcaccctcagagatttaagacgacagcaatgagtccctctgatgtcttctaagtgagctttattttcaaaacaaatcattttccaataacctatcaaaagcaggtcctacctgaatatccttggctatttcctctggatacagataatgccttcctccaatggatcctcggctcacctgatgattgtgtgaaactggccagagaaagcagagggatttttcctggtgattggaaatcagagtcacggctgaatttaagcaactgtgtgaactcagcaaagtccccaccacctggaccatacatgacagctatggttattgacaaggtccttccttaatggagctggaacctccttcttaatctaaatgtggactcaaatgaactgtcaattcacatagagcaatgtgacaaatccggggggcaaagcattatgcaatagattgggcacatgcgcacgtctctgctacttagtcaactttcttctaaagtttcccacttttcccattaccacaatcaagatcagatatcagtaatattctccgcgtcccatgccctttcctcagggagatgccaaggcccaagagctggtccccccaaaaagctgaaggtctttgaaaaaaagtggggactcaggtcccgtgagtggttttgattttcttttcttttgaaagttgcatgtaagtgttttccaaatactatacaagaatgtctataacttaataatggaggaatgttttcgttgttctgtgttggtgagatgctttcctatgcgtttgttgtataagtaagtgagaatggcagaaggaaaggaggggagaggctgatcatcctatcccgtctcccactctgggggtctcggcgcttccagcctgaagcgcgcccgctgcgcgtccggagacgcaggttccaggagccccccggggttgcccgactaggccacttgcgccccggaagagggccgcggaggtgggagaccctaacttacccgggtctgagatgccgagagagccgggtgtggagctgagtgcgcgcctgccgagcgctgaggccacagacagccccgccccggggcggcaccttctaagggcctgagcgctgcacagggatgggggcgggcggggcctcccagagccgccaggcgtcccgccccactccgcccacacgcacggcccagcccagggttccccgggaccaccccagaccagccccggcccccccgggtcctccacactctgcaccccagaccaacaccaacgcgcgtagggaagcgttttagatcctgtcggagaggctcaaggccggcagaaggtttgcattaggatcgagaaagccgaccaacggacagatctacctaccttcctgcgggagtttgaggttgccaggggggaagccactgcagccaggagaaaggccgtctgggaaccaccccaccctcggacgtgcgggccttcaaatatctctgaacataatcctccaaagaccgctcaacctccgctcccgacgactctttctagcctcgtcccgcaccccagctgtggccacacacctattaggcaaacatttatgaagcacccacttactgggtgtgcagccctgagctgggggtgcagctgtggaccagacaggagggggcccggagcggcagacagtcgctggaggcacccgagccttggcgagcacaccctaacgtccttggggcctttcagcccgagccgtccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctagggcttcacttgctttctatctgcagacatcagagggacccacatctctctgttctgacacgctgtgtgttgatggcagagtttaattatccacatgcaatcttactttccttattcccaagtccgtggggctgcctcatcaaagcattgtaagaactgataaccatcttctagaagtatcatagtgatattaagaacacacatcacagatcatagtaaatggctttaattttttagcgaaatctcactactgcaaatgcattgttgtcctagctaatgaatgcatagagtattgcctgcaaaataataattgagattctatttttaagaagcttagaacagtacatggtgcatagcaaagactctgtgtatgtgaagccagattttaaaatatggtaacaagtgtctgaaaatatgtggctcaatttgtctcccggttacttttccctctccccctttaaaatgtagaggaaggagaagaagagataagaggtttgtgagtgaagacaagggccctttaaggcctgggaagactaacgccatagggatctccctctgccttaaaaggcacaggaatcttagtggggaaaaagaagtggtgataaatagccagtccgtgtgcctggaatatcaaagtcagtgcgtgccagggatcacactgcgggtcacgtgcactctgggtctctctctgcaaacctgccctgcctcagtctgggaatatgcaactgcctaagaagggtctggcttacacaggggccatgagacgtggcaggcatagctgggctgctactggtcatgaatcctggacacggcaggcaaggtgtggtgtccatatgcattattcgggtggggcaaagatcacagctctcactagactttcagaggactttgtaacccaaagaaccactcatctcaaggactgtggtaactcaggggctgagccatgccagtgtttattatgtgaaacaaggactggaacctcacaagaccaagtctgtccatttgaggatggcccaagatgcacacgggctgcttttatcttatgcgcaggttttaaaaaaatatgtttcatttaaatattccatactcttcaggaatgcccaggcagctgagctttcaggatgtcgcattgcagaggactccaatgctacatatggcagctggagaccctttcaaggcaggtggcagaacggaggccctctctatctgctggggcagccctccgggtgccccgctggaaggcagagcagctccatctctgggtgggtgagaggtgctgcatgggctcactatagtatcccaatactgtatggcagtaggctgccagagtatcctaagctgggtggcttcaacaacaggtactgactcacagttctggaggccaaaagtttgaattcaagcagggctgtgcttcctctgaaacctgtgggagaggagccttcctggcttcttcccgacttcttgggatggggatgcgcatccatcctcggccttccttggtttgtggctgtgtcactgcaccctctgcctctgtcacggcatggtgtcctccctatgcatctgtgtctgaatttccctcttccgataaggactccagtcatattgggtgagggcccaccccaatgacctcatctcaactagatcatctgcaaagactctatttcccaattaggtcacattgaaggtacctgtctttttgggggatacaattcatctcacaaaaccggcccatcacctcaaaaggacctgccaccccagtgctatgtgtccctctctgcccagagccactccttcccctggctctcggggagtgggggcacctttccctgctcccacagtgaccgagcaccttccccttggtatgcattctgaagggggcatttttttctcctccatctcagccctgtacaaagcaagttctttctagattgaggtgtgtatgtgtgtctatgtatatgagtgtatgtgcctgtgtgttttcagggagatgtgtgcaggatgggtgcaagggaggagtggaaggcggaagggcaggaggaggatagagccacaagagtgagcacagaagtgacaagggcagaatcagtgtgtgcttgtgacaagtatggaaatgtcatgcctttaggttcagtcctataaggtaggtgtatcagtaagggcattgattctgcgaccttaacagagatcagaataacagtggcttaaggaagagtggagtggatttctctctcctgtaaatctggcctggtgggtggtaaggaggatccacgtcgcccaggcccagatgtgtgtggctctttgagtgccccgttctttcccagtctcataactgctctccacctcctccacatccagccactgggaagcaggacaaagttagttaagggcacgttcttttctttccaaggattacttggacattacagtcttcacttccatgcctactggccagggcttagtcacacaaccttgctagctgcaagggagtctgggaaatgcagctgctattctcagaggccatgtcctcagggattctgctaaatttagcaaggcagggacagatatgggggaaccactgacagtctatcacaaaagaacgtgattttagagaaacagtgaaacagtgtcattaatccacccctcaccccttacaacagccaaaaagaaatccagtggtatccatcacaataaagagtatgagaggaatgtgattagaaaatcaggttgccaggcaggatgtgtccagttttagccagtggtggggttcatggggaaggcttcgtctcaggaaggtgtgtgttgggttgttctatggccagatggttttcaacgacatagcacgacctgtagctctccaggacccgggcctggacataggccttgtccttctcttgccaggcatcggactcgatgtagacgttgaatgggtcgttcgagtgctccagcttcttggagcggatgtagctcagcatgatgcccagggtgaagaagccgaagaatcccagtaccatgaggacgtagagggcctccagcttgccgtcactgctgcggggggacctgcgggccaggcccgacatgttgccaccctgctgaactgtctcctgccacagcttggtcagaaagggcgtcaccgctgtggtgttagacaggatcatcctgggcattaaggttccactgctgcagctcaaacttcccaggcacacctcttaaaggaaaaatgcaaccccaaatcaaaaagtacgtattggccaaaacccacacgtacgcacacacacgtatacaattttaaaatctcaggtgagaggggtgagctgacactccacaggccatggcatgtgccatcttgggtctgtgcaatgccttctcttgatagatgaatggatacattgattcccttctatttccatccaccactccaatctccacccctataggtgaccatcagaatgagcttctttaatatgcattgctgcatattgtggcgtatggggttgcatgtgtgcattttggtttacctaaatggtatcaggtcatccaactcattcagtctccttctttttcctcatgactgtgcttttgtggctcacttgcggtgctgggtgtgtgcattcccttgcttccaatgtttgtatacaacccatggtgaacacccacttcttttctctgccttctcccccagagatggacactgctgtggctgctgactccataaacaagggggagacaaatatccccatccttgacctcctatggacctaaaaaaaatcacgcatctcatacaactagttcctggcagcttatgcaagactagtcagactggttgcccttggaagcaacgtgcaattggtggtctgtttcaccacagagcatctctctatgaacagttacattcatctgaatgaaaaatctatgctgtcacgtggtggacttcagaatgtctagggagatttcacagagagctcccctcgaagaggccagtgttgtagcttgtgctatgtttttccctccctgcccacacacaggcacacacacgtacacaatcttaaaacctcaggtgagaggggtgagctcacatgctccctagtccatggtatgtgccgtcttgggtctacacaatgccctctcttgattgagcaatggtacatggattgccttttatttccattcactactctctggctatgcagaaagtgacattttccctatcgtttaatcttgatatcactgtccctgtatactcagagtgggcctgggaattggaaaaattgtctccaagtagctgtaagattctgtcaggggtttggtttgctgtggaaaccccatctaggtgaccttgagatcattggtaagctgaaaaaaaacaggtcttgtttttatttatttatttatttatttatttaggtttgagcaaatgccagcctctacccccagttcctgctgggaaacaaaagctccgaggccaagttgttgatgtcacattccaaactcaagccagagggggccactgggagcttatcacacgtaagtgctcccactcagttctttctttttctgttttattgagacagggtctcactcttgtcactcaggctggagtacagtggcacaatcttggctcactgcagcctcaacctcctggactcaggtgatcctcctaccctaccctccagagtagatgggactataggtatgcaccaccatgact

SEQ ID NO: 5 - DNA, 24608 bp, Homo sapiens
  misc_feature: KCNE2 gene
tctagaattatcaccattcttttgggatacagtgagagcttttttccagccagacacagaatgggcaatacaggtaaggtccctgttgtcatggagctcaagttctgttagagacaggaaagaaaaaaacaatcaataaaacaggaaaacttcataattcaaagaagccacgcacagctgtgagactatgcacaggcaccattcacactgtagactaagtgacagctgcccccgggttaagccctgccttgcctgggcaacagtacatggcatccccacacaattcagataatacaaagtgctatcagggaaatgtgaagaaggaagaagctgtgccaagattgggggaaaagcattagaggcagagagagcagcgtatgcaaagatgctgaggcagtccgtataattgcaccatgaagaggtccctgtcctaatctctggaagctgtgaatatgttaccttacctggtaaaatggactttgcaggtgtgattattaagttaaggatcttgagatgggaagatgatcttggattatccagatgggacaaatgcaatcacaaggctccttataagaagcaggcagggggctcagggagtgggagaagatgtgatcacaaaagcagaggctgggccgggtgcggtggctcatgcctgtaatcccagcactttgggaggttgaggcggacagatcatttgaggtcacgaatttgagaccagcctggccaacatagtgaaaccccatctctactaaaaatatacaaaaattagcctggcatggtggcaggcatctgtagttccagctactagggaggctgaggcaggaggatcacttggacccaggaggcggaggttgccgtgagtcaagatcgtgccgctgcgctccagcctgggtgacagaatgagactctgaaaaaaaaaaagaagaaagagaaagaaggaaagaaagaaagaaagaaggaaggaaggaaagaaagaaggaaagaaagaaagaaagagaaaaagaaagaaaaaagaaagagaaagaaagaaaaagaaagaaaagcagaggctggagggatgccaggatgccagggagagggccaagagccaaagaatgtgggtggcctctggaagctgcaaaaggtaaagaaatggattcacactccctcctcaacccccagagcatccaaaagaaactggctctgctgccatcttgatgttaacccagtgaaatccactttggacttctgacccccagaactttaagataatattataaatttgtgttgtttaagtcactaagtttgtggtcatttgttataacagcaatgggaagctaatacagattcaaagacaaaaacaaaacaaaaagcagagaagcaggatcagactatgtgagaagatgagctcgcagaaaggaccagcggccagtttttccatggcctggccagctgcactaagcattccgggttttattttcagggtgaaaggaacccaatggagagtttcaagcaggggaattgcgggctgtggtttgtgtttccaaaagatcccactggtccctcttagaaatatgtgaatagggacagagtgcaaagccagaggcgtgagcggccagcagtccaggtgtgagctgagaagtagctgtgcggggacgtgtttggagagtcaaattattactataataataattattattatttagagatggtgtcttgctctgtggcccaggctggaatgcagcggcatgatcccggttcacggcaatctctgcctcccgggttcaagcgattctcctgcctcagccacccaagtagctgggattacaggcacctgccaccacacctggctaatttttgtatttttggtagaaacggggtttcaccatgttggccaggctggtctcgagctcctgacctcaggtgatccaccctcctcagcctcccaaagtgctgggactacaggtgggagccactgtgcccagcctggagcgtcaaatcaaaacaaaaaaaccaacagagcagtaagaaacatatttcaatttattaccttcggggctaggggaagagagacaagttctaagaggcttttcgtgcaaaaatggaaagaactaggtttaaggcaacagtgagaaatgacaatgaaaaaggcaagcttctgataacagctgtctgtttggctggtgagacggattgtgactcttctttgcaattggccattgtactagtttatggcacaaaaacccaggcacagttttcaaagaagttgagatggggtattaagggtctggtgggttcgatgtcacccagcacaaactcatacacccacgttcaacctgtgcagagtcttttctttaacaggatgcagagtcaacagtatttgctagtgaattgggggtgtggcagggtgaccaaaaaaaaaaaaaaaaaaaagaaatctaagttaattctttggttttttggcttacacaactagaaagaaagtggagtcactttactgtgataggataggagtaggtttggtaggagaattgagttatgtttggacatctgaggttgagatgcctattagacatctgagtgaaaatgtcaagtgagcatcttgacatttgattctgaaattcagagaagaggactggactggagatacacatttgcaagtcccctacaaatacatggattttaaagaaatcaactttattgtggtatagtttacataaaattatacacacccattttaagtgcatggttcaatgagttttactcaggtaaccacctacaacaaccaagatatagaacaattctatcaccctccaaaattgtctcttaatcctttgcagtcaatcttcccctcatctggtcatagaaaactactaatctgctttctgtcacgagggatggcttttgtctttctggaatttctagaaatggaatcaaacagtacaacttctttgtgtctgacttcttttgctcatataatctttgtgggattcatccctgttggtgcatgtatcatttatttgttcttttttattgttgagcaatatttcattgtgtgaataaaacacaatttgtttacccacttatctgttgagggatatttggcttatttccagtttttagctattttgaataaagctgctataaacattcatgagtttttgtgtggcatattttgaaaatttctctaggtaaatacctagaaggggcattgttgggaacttttgatctagttaccaaactgtttacaagtggctgtatcattttacattcctaaggcaatgtatgaaaatccacttagcccacatcctcaccaacacttggtgttgtcagtctttttaaatgtagccattctggccaggtatggcggctcatgcctgtaatcccagcactttggaaggctgaggtgggcagatcaccctgaggtcaggagtttgagatgagcctggccaacatggcaaaaccccgtctctactaaaaatacaaaaattagctgggtatggtggtgtgcactgtaattccagctactcttgttgaggcaggagaatcacttgaaccctggacagggaggttgcagtgagccgagatctcaccactgcacttcagtctgggggacagtgagagattccatctcaaaaaaaaaaaaaaagtagtcattctggtgagtgcgtagtggtatctcattgtaattacaagttatatttccaatgacgttgagcatttatgtgcttattgtatatattttttggtagtgtctgcataaacctactgtccattattattgagtcaattttttttcaaatgatgagttctttatgtattctagatgcaaatctgttgtatattctagatacaaattcatggtggttatttttttcagtatattacttgcctttttattttcttaattatgttcttcaaggagtaaaagactttaataatgatgaggcccaatatatcaatattttccttttatgatccatgtgtttcagtctttgtttcctccatctgcttttaagattttctcattgcttttgattttaagcattttatgcaaaggtgtgactttctttgaaataattctctttgagctttttagttcttgaactcatggcttgatttttttaaaaagcagttttggaaaaaatctcattcactatttcttcaaatattgcttcagcttcagccactttctcctctctttctgggactccaactgtacttctgttagtcctttttcctgtatctctcatactttcttgggtgtatcctattattttgttctgtgcttcactgtagatattttctgctgactagatttctaattcactaatcctctcttcagctttgcctatgctgctggtaaatccatccactaaattgatacatttaaaaaatagatttctgcggagattctatttattcttgggctgactctggaaatttatatttttctggcaaattatatatttcatccaaaacttcaaattgtatttccagagtgactttttatttagttgattctatatttatttgttttctcttttgttcctttctgtttttgttctaaagtttcatttattctacatttttagtttattttttggttcttttgctttttgagtttaatgagttcctattattttccttttatttatttttattttttagagacagggtttcactctatcacccagactggagtgcagtggcaccataatagctcagtctaacctagaactcctgggctcaagcctcttcccacctcagcctcctgagtagctagggctacagctatgcaccaccattcccagataattttaaacaatttcttttttatagagatagagtctcagtgtctcactatgtcacccaagctgttctcaaactcctggcctcaagtgatcctcctgcctcagcctcccaaagcagtgggattacaggtataagccaccatgcccagcctcttttccttttagtgaattcatttactgtataaatttgcctctaaggttcacattgtctgcatcccagaagttttcaaatatatggcagttcctttgtaatttaatatcttattatttatgtgttttcctctttatccatatgttacgtgatgatatacttattttttggttttcagatatatcaaggtgtacagactatatttttgctgatttataattcaactgcattgtagtaatggaacccagtctacataaagctgatatttaaaaatttggttggacttcttttgtgacccagcacatggtgagtttttaaaaccgttttatggacacttataaagaatgcacatcatttgttggttaggtgtgggttctctccatctattttataaaggtaattaattctattactcaattctatatgtttactttttaaaaaaatctatcagtttctgaaacctaattcctaccattgtgcatgcctcaatttcttgtaaatctgcctgtttcactttgaatattttgagtccatatacaagcccatgattttactatcttcttcgcaggttgtttcttttatcaaattgtagtgacatttaatatcctatggatcacctgaaatttcagtttttcttagatgtctgcattttagccttagcttgatatgttttttcatcaccttattttcaactttttatttgtttttattttagatgtgcatctttattttgtattttattttttgagacagagtcttgctgtttcacccaggctggagtgtagcagcgtgatcttggctcactgcaacctctgcctcccaggttcaagtgattcttatgcctcagcctcccaagtagctgggattacaggcatatgccaccatgcctggctgatttttatatttttagtagagatgaggtttcgccatgttggccagggtggtctcgaactcttgggttcaagtgatccgcccgtctcgccctcccgaagtgctgggattacaggtgtgagccaccagccccagcctagatgtttatcttttaagaagcatatagctagattttattttgttattcagtttaataatacttcttttaataggtacttattttaaaggatattgtgattatagatatattcagatattatcttagtcattggggcagttatagtaaaaattataaactggatgacttataaataacaaaaagttattgctcatagtttggaggctggcaggtccaagaccaaggcactggcagatgcggtgtctggtgaggtctccctctttgattcatagaccgtgccttctagctgcgacctcacatggtggaaaggggaaggcaacctccctgtagcctcttttaaaagggcattaatcgcattcacggggtctccatcctcttggcctaaccacctcccaaaagccctaccttttagtaatatcacatggggagttagaatttcactatatgaattttggggggacacaaacatttatgccacagcagatatctttctaccaccttatttggtgatttctgggttttgtttgtttgtttaagacagagtctcgctctgtcggccaggctggagtgcagtggcaccatctcggctcaatgcaaccttcgcctccccggttcaagcgattctcctgcctcagcctcccaagtagctgggattacggacgtgtgccaccacgcctggctaatttttgtatttttagtagagactgggtttcaccattttggccaggctggtcccgaactgctgagttcaggtgatccacccgcctcggcctcccaaagttctgggattacaggcgtgagccaccatgtccggctggtgatttctgtttaaaagttttttcttaaagtgttttttcccacctagtttttcattgaatgggtaaaacattctacatttgcttttattaaaacaagaaatgaattttgctgcatttcaatttatagattttactatcctacctcgtgccaggttctgtgctaagtgctgtatatatctgtgatcacatttaacttttataacaagccaaatgagcaggaactcttatctctatcttacagacgaagaatccaaagaccagggacagtaagtaatttgctcacctggtttgccagcctccatgacacatcgccgtccagttctgcctttaattaccaaagcacaacacgctgctttgattcccctctcctcggcgccagaattcaagagtgaagttaaaccgcaagggctgagttagaagattggcctcagttccctgttcccaccagcaggtggcaccgtctcctagcggaattcttacttgaacgttttgcttccatttctgcagaggcatggtgaacacagttacaccaccaaagtgttcctcctggctgagtttgcctatcttgttcagtgaagacaacccatgaggacaaatggtgttaatgagaagcttttgcggagttacagagatcctcgtatttctttaaaatacacctaataacgttaactctgcaataatttgtagatcatgttaaatcttagctatcttcctcttgccacccagtgtgcttcaagccacatggttcagagcaccatttaatgtgaaactccaattttaaaacaaagtgaaccttccttttacaaaaccatgagacaagttacagagtaatgaccacccacatgaccttgaagtgattttgagtgagtgagtgtaacttccgtggctgccatttaaattggattcaaatccaaatggctccacctccatgtcatcagacctcttgtgccctgattcccttggctaagttcacagtaccttccacatcaggttgtggcaatgattacctgaggttaatacgataaaagcacatggtaagcactcctaaatgatagccaatataaagactcagttctcccaattccaagggtccccaccatgatagaaaaggatcttttggtaaatagagtatgtttagctcttgctaggtctttaaatactttgctgggggccaggcaccatggctcacacctgtaatcccaccgccttaggagactgaggctggaggatcctttgcggccaagagtttgagaccagcctgggcaacacagcaagaccctatttctacaaaaataaaaataaaaattaaccaggctttgtacacacttgtagtcccattacttgggaggctgaggcaggaggatccctcaagcccaagagttcaaagctgtagtgagctatgattgcgccactgcactccagcctgggtgacagagtaagactctgtttcaaaacaacaacaacaaacaaaaacctcaaaacctctttgttggacttaacttccagctcctccatgtagtaccttagtacccttgcagcccgtttctcttttacaagacaacaatgttgttataaactcatttggatgtggtcccgtggaggagtatttaccagaatctagcttatttagcgtcttcagaacacggcacttgcctggaattatactgaccccctcaacccataccaaccacccagagatggctgttcttggctcctctccctggggccctgtccttcccacatcgtcttcttcttctttcttcttctttcttcttccttcttcttccttcttcttccttcttcttccttcttcttccttcttcctcttcctcttcctcttcttctttcttctttcattgagacagagtctcactctgtcacccagcctggagtgccgtggtatgatttcagctcactgtaacttctgccttgtggattcaagtgattctcctgcctcagcctccagagtagcagggactacaggtgtgtgccaccacacctggctaatttttacatttttaagtagagacggggtttcaccatgttggcaaggctggtcttgaactcctgatctcaggtgatctgcccgcctcagcctcccaaagtgctgggattacaggcgtgagccaccccacccagcccttcccacgtattctggcagggaatgctgttgtcccccaagcctaccctaagaggaagacttcttctggggaaagatgttcactgtacccaggccctgccctggctggagctggcaggaagggtcccagagcaggaacttgtgccactctgcccaaagccagagtccctgaggcacacaccccatcaggcaccaaggtgaattccaactgccagttagtatttaactttccacatacgattagattaaacatgtgggttcataaaagcataggattgcagactgcagttgcaagggcttagatggttgtaaggtgaaggtgcccagcaggctgaggcttgtgtgcaacccagaagagagctcgctaacgccagcaagaaggttcagaacagcctggctttggaaaggaatttcatcctgcccacacactgcataggtaagtcttagcacacattctttattttttgaggaattaagtaacaaagttatctatgtgccttttccagaaaatgataaaaggaatgattttcctggtacatggcctggctcctcatccactcttccttctttccttcttgtgttttccttactcatttctttgttaattgccttagaatgaaaattttgagagtttttaaaatggaggattcatggtaaacgtaggtaatcatattgttttctcttcttgatataaaaatgaaagactttgctgccttttataggcccaggtgatgtgagcgatctaccatgtttcaagaaaagaaaactttggggctgggcgcggtggctcacgcctgtaatcccagcactttgagaggctgaggcaggcggatcacctgaggtcaggagatcgagaccagcctggccaacatagtgaaaccccatctctactaaaaatacaaaaaaaattagcctggcgtggtggctggcgcctgtagtcccagctactcaggaagctgaggcaggagaacggcatgaacccgggaggtggagcttgcagtgagccgagatcacgccactgcactccagcctgggcgacagagtgagactccatctcaaaaaaaaaaaaaagaaagaaaagaaaactctggactttggggtcaaatgagtgttactttcctaatagtgtcctgattgctgttgtcatgaataacacacattcatgacaggaatggctggaattaggggatcattctgtagcctggagacagggcacaactaatgacatgtgtaagctcaaatcatggtcttgatcttatgtcttgtacccagttgagccaactggtcacagcaatgaaaacagtgagttattggaatgtgtgacctctgctaggacagtcagtgctggacactggcttgggtgatgtgagttctagtccaggcactgtggccaacttgagaggcttgtgatcttggacaggtgacttaagccctctaggctatagttattccacctatcagagagcaaaccagcctaaatgatctccaggggcccagcctgtgctaggactcagcaagaagcattcactggaaatgtaggtcctcctaggttgatacacatgaattgcccatatttgaccatttctaacctatataaatggctatttcatataattccagagaacataaatggtagttgtcttagcattactaaagtaaatgcctattatgatattctacttaggggtaggataagtatgtataccaaatatggtttgtttcgatttgatttttgagacagggtctcactgtcactgctgagtgcagtggtgtgatcatggcttactgcagccttgacctcccaggttcaagctatcctcccacctcagcctcctgagtagctgggactataggagtgtgccatcacatccagctatttttttatgttttgtagaggtggtgtctcgctatgttgtccaggctgatctcgaactcctgggttcaagcgatcctcccacctcggcctcccgaagtgctgggattacaggtgtgaaccactgtgcctggcctccaaatatggttgatgtctatcagtcagttaaacagtaattctgggaataaaaaattgaaatcaacccacttataattggaatgtcttagcataatgtccttcaacgaagctgctttcacacactgtgatttgtttttttcctgtggtcatggagcaggcatgggccactcggccacatctcatgcatccgtattcaaaagccaaatcccttttggatcctgtttatttggcctggccacgggtgagcacttagacatttaatccctataggccctttcatccctgtgattaagtcttatcaaaaagcacctcctgaccggcttagcagtggggcctttgttcacattagaagggttgaacaaataatgggcagttggggctgcttagctctaaaaggctggtgaacgctgccatgcctgcacctggaaacaaacccaaatgactccagtggaattcagcactgaagtccctcatctcaaagaccttttgtggcagagactcttggatgggccttaggggtcccaggagtcccctgaaattgaatgtagagcttcctacgtgcataggtatactttcttggggaaaaattaagtcacatcattttattttacttttcgagggatctttaacaccgcccctcccccacccccaattcccacaccccttaagaataaattaagaatcactgttctggtagtttccagttgaattccacagaggaactgtcattcattcacaccttcattcaacagatttttagtaaagatttgctacgtacccatcgctgtgtagggtcccgggattcagagatgagtaaagcaatccctgccttccgggggctcaagctctcctgtcatcgggactcagttactgaatctcactaaacatcctgaaggtaggagtttatagagtggttttgaggatcacatgaataagcacacaatacatgggtaattcaaaaacgaaaacaaggccgggcacggtggctcacgcctgtaatcccagcactttgggaggccaaggtgggcggatcacgaggtcaggagatcgagaccatcctggctaacatggtgaaaccccgtctgtactaaaaatacaaaaaattagccgggcttcgtggcgggtgcctgtagacccagctactcaggaggctgaggcaggagaatggcgtaaacccgggaggcagagcttgcagtaagccgagatcgcgccactgcactccagcctgggcaaaagagactccatctcaaaaaaaaaaaaaaaaaaaaaaaaaaaggaaaaaaacaaaactaacatggtcatttgcagaaggggcagaaaaagggtctctgcctagacctggggaggtcagggaaagtactatggattggtaacaaccggctgggcttcctacaagagaaaaagactatactcacagagccagaccccatctcaaaaaaaaaaaaaaaaaaaagtctggcatggtggctcaaacctgtaatcccagcaccttgggaggctgaagcagggggatcacttgagcctaggagtttaacaacatagtgagacctcatcactacttttttattttaaaaaagagttaataaaaaataaaatgaaaataaaagggtaaaagagccagtggcaaagtcttgagtggattaaagccagctcagctaactttcacagcagactatatcattttaaaggggaaaaagcacatctctgttacattgcttaggaaatatgcttggtatataccctggggcaatcttatctatttgttaagtttccttccaacccactagcctgtgtggccaggagagggagacaaagatcttagagctctctaaataatagaacttaaaacatcagacagagaagagtatattatcttggtgatggtaattctcaatgaggaaaatcctggggagggatgttctgtgggagaatgcctgcaagtttatttgtttagtaggtttgattattcagctgattgaaattcctttcccagatggggagatctgattctcttttcatgaaggaaagaaaagtcacatgctaaagagacgggcatgtctttagaacggcagcaggcaaacccactgctgggatcctggggcttttactagtggctagtcacaggtttacctcctgcctgtgctccttctagctgtgttgaaacccacttgccccatctatgaaccgtgttcagctccattttctgagcccccttatctttttgtccatacctgttgcaactctttgcacgttgcattgtcattgatttggtctctcccattcaactgagcctctcacagagttcctgtcacctctgcagtttcatcgcctagcatagtacctggcactttaattcatgcatcaaatgtccattgagtgccttctatgtgttagacatctgctataccgagctagacaaagttggcagacatgacagccgagtggaaaagatgagcccctaaaccaataatcacacacacacacacacacacacacacacacaatatatatatatatatatatatatatatatatgtatgttatatatatgtatgttatatatatgtatgtatgtatgtattaaaaaatcttggccgggagcggtggctcacacctgtaatctcagcactttgggaggccgaggcaggtggatcacgaggtcacgagatcgagaccatcctggctaacatggcgaaaccccgtctctactaaaaatacaaaacattagccaggcgtagtggcggttgcctgtagtcccagctacttgggaggctgagacaggagaatcacttgaacctgggaggcagaggttgcagtgagccaagatcgcgccactgcactccagcctgggtgacagagcgagactccgtctcaaaaaaacaaaaaatttttgccttgcaatcgtttgccttgatgttatgtctaaagccccacaattctctaaaaacagagatgtataaaaaagcacacgtatataattctctgaaaacagaatataaatgagtcattgctccatttaactgacatttgttgagtgcttgttataaatatggcattattctagctggtgtgaggttaccaattttttttaaacaaaagtaatatgaatatatacacacacatttagtgactgcatatgtgatgtgtgcttttgaagaaaaaggagatgctgttggaggaaaatggtggtggtggtgggaagtgatttagagtagaaccagggaagtctcagaagtgacaactagctggaacctaaagaacgaggaggtagcaggtggaagagaaaggcaaaggcattctaggttgagagaataggatgtgataatgtcccgaggaaagagagcttactgacagggagggaagatgtcaggtgtgaccgaactgtagtgagcaaagggtaactgaggaggtggtcaggagcctgctcagccaatggggtaaatactgttaaggaattaggacttgattttaagaacaaccatcgcatcattttaaaagcaaacaaattgcactataatttccctcttcaaaaaggcacattggctgtgcacggtggctgacacatgtaatcccagcactttgggaggctgaggcgggtggatcacctgaagtcaggagttcgagaccagcctggccaatgtgttgaaaccccgtctctaccaaaaatacaaaagttagccaggcgtggtgacatgtgcctgtaatcccagctacttgggaggctgaggcatgagaattgcttgaactggggaggcggaggtttcagtgagcagagatcgtgccaccccactccagcctggacgacagagcaagattccgtcttaagaaaaaaaaaagggcacattgatggctattcaaggcagagaggggcacatataaccccaaagagatggctctggggagggttgtgttgtattacattgttggcattgtattatccaggtgagagatgctggaggctgggcggtgccagtggtgatgaaaaggagagatggatttgaaacataggaataatctctcagattgtttcttggcatcacttacctaaaatgcttctttcaaatatagatgtacacacccctccctttaggatacttgggacaatgtgccacttagacataggggatggaacaaattggagagtctgtcaatgccccctgcaatcttttctcttgatgttatctcataatgccccacaattctctaaaaacagagaacataaatgagtcattggtccattccactgacgtttgttgagtgcttgttatgaatgtggcattattctagctcttgtaaggttaccaattttttaaaaaacaaaagtaatgcaagactgctgatgaaaatttggaatatgagaaaagcataaagaagaaaatacatatctttaagcacaccacccactgttaacattctgatctatgtacttctaatattttctccattttcatatgtacacatacatttatttacatgcatatataaatatcaaagtgtatatatataattttctctgccatttaaatttttactgtgtaacaatcatggattgtaaaaaaagtgaataaaatgtacgcagtcagtttaaagactaacaaaatatgcattaaatcaccagccaggttaagaagaaatactattacttataccctggcatctccctcccacctttacatagccaaatccagaaaagatccgttttcctaaccttgttcgcctattttattatttaaattgcagcaggagggaagcatgtctactttatccaatttcacacagacgctggaagacgtcttccgaaggatttttattacttatatggacaattggcgccagaacacaacagctgagcaagaggccctccaagccaaagttgatgctgagaacttctactatgtcatcctgtacctcatggtgatgattggaatgttctctttcatcatcgtggccatcctggtgagcactgtgaaatccaagagacgggaacactccaatgacccctaccaccagtacattgtagaggactggcaggaaaagtacaagagccaaatcttgaatctagaagaatcgaaggccaccatccatgagaacattggtgcggctgggttcaaaatgtccccctgataagggagaaaggcaccaagctaacatctgacgtccagacatgaagagatgccagtgccacgaggcaaatccaaattgtctttgcttagaagaaagtgagttccttgctctctgttgagaattttcatggagattatgtggttggccaataaagatagatgacatttcaatctcagtgatttatgcttgcttgttggagcaatattttgtgctgaagacctcttttactttccgggcaagtgaatgtcattttaatcaatatcaatgatgaaaataaagccaaatttgaagtaaagtgtctgggcagtggctgtggggatagaaaggagagatttacaaatcattgaatcttctttctcatgaaacatcatttgtgtgtgacaaattcaatttataaataacccagatgtattatgtagaagctgaggctcaaaagctatcacttgcttaccagacggacataggagcatttatctgtaatattaattcatgagtgtggagtctgaagagatgaataaacaaaccataagattactttacatttattgttttcctggcctttaacctatttagaagtcttaagacagaacaaacatttttctttttctttttctttttcttttgagacatggtctctctctgtcacccagcctggagtgcagtggtgcaatctcagctcactgcagcctcaacctcccgggctcaagtgatcctcccacctcagcctccctagtagctgggactacaggcacgtgtgccaccacacccagctaacttttgtatttttttgtaaaaacagggtctcactatgttgcccaggctggtctcgaacctgaacaaacatttcaaaggacaaataatccataccagagaagtagagtatttaagaagtacccagtataacaaaacatattttaaaactaacatttaaagttttgcagaaaactaatcttaaaaagttctcattatttaagaaaaaaaaataaaaagttataatgtcgctttaaaaatgtattcttttaacttgatttagttttcctctatttataattagttgttagcatttatgtttaagaaactaaaggatacagaaagggtctaaattgctgatgccctctgaagacctagacaggaactacttaatatcttgcaccatgtggtgcaggatatcatagaatgtcagggctgatcattctactgttggcagagaccacttcacttacagatgagagaagggcagtccactgagaggagacaatttcattcactaattcggtcaggcaacattgacctacttggtccactggcctagaccccaagagtataaagatgagcaaggccgggcacagtggctcacacctgtaatcctagcactttgagaggctgaggtgggcagatcacctgaggtcaggagttcaagaccagcctggccaacatggtgaaactccatctctactaaaaatataaaaattaaccgcgtgtggtggcaggagcctgtaatcccagctactggggagactgaggcatgagaatcacttgaacccgggagggggagattgcagtgagccgagattgcatcattgcactccagcctgagtgacagatgctaaacatcatagtacaatgtgacaaggtcctaacagagatcaatgcaaaggggacacagccagccagcacaaggacaggagggcatgcctaatgcaggtcaaggtcttctctctcagagcagctgagagtagcaggtcaatggcagcagagagatgtggggcctcagcatcccatggcttcatgcctcctagtttaccctgttctcctccccatgccccagccaaggcacagcaacgatgggcaaggcctcaagcctcagggtgctaggacaaaatttagaaaaagaggctcttcttcagagaatgcttgtagaactcgttattccaatcacaaggtttgtctctttaaaattacagagtgagatatgtacaaggtatctacttcctaataacagatttgcaattatgccaactgaagcattcagtacagttagagaaaaccatccatattccaagagcagatgtaggaagagtggcttccctcctcagatcagaaacccagaaatgttgtcccacccagaaacatccatctcagagaggccagagcagccatcaggctttaaatcccagccctctgctctgcatccagacagaaatccgaggtttccatcaggtgacaaagaccctctccttaaccaaactgtcaagctcctctgagccctcttcttgactagagcccaaccatggccctataaaaactgcagactctcagcacacatgatttcgcccacctttgcacactaagagacataaacgctagcataggttctaagagctgaaagctaaagcgcctgcccgagaaaagtgaatgcggcctgaagaatttactaattgttccaaccaaaacctggtgacaggcagatagtcccctgatccctctcttaaggcagttactttagaaagtttgcaattataaatcctttctctctcccttgagatgtatatcttctaccattcagaactgtattgtctctctgaaatgcaaacattcaaactctccttgctggatgggtgccttgctctaacttactgctccccatcacagacagaagtttgtttctactctagataggagccaattaacaaacccagatcacactgaccaaccccttcccactttctatgcatttccacttcctggactctgctcaagccccatccccactcagttacctttgcacaaagggaagttgagctgggcctcttccctctggcaatagctaatgatttcagtcaatccttactgctttaactggctttctttacctttgacacaggtaaacacatggagagcaaaatcgaggtttttctggccgggtgcagtagctcatgcctgtaatcccagcactttgggaggccaaggtgggaggatcacttgagctcaggagtttgagaccagcctggccaacatgatgaaaccccatctctactaaaaatacaaaaattagctgggtgtggtggtgggtgcctgtaatcccagctacttgggaggctgaggcaggagaattgcttgaacctgggaggcagaggttgcagtgaaccgagattgcatcactgcactctagccttggcgactgagtgagactccatctcaaaaaaaaaaaaaaaaaaaatcgaggttttcctaattaagtacattttattatcatcactgaaagtacaggtggtaacatagagggttatcagccaacttcacttttggggaatgggagaaatgctgactctctccaagcatgttgggtgtctagtggttgaagccatttgccaagattgtcaccctaggatccactcccaccaaacctgggcttttcactttcaacccagcaactgaaaatgccagttcaaacaacttgctgtttttttctaccccacttgcttttagagttccttctgcctgttttattggctccatataacctgaataccacttatttcttaaagcatagctcagatgctattttaaaaggagcccaggatagtggctgatttgatagaatctatacccagattacccagggtcaagtcccagctctggtacctgcggcctttaaaaccacgaaaaaattactttaatctctgtgtctccatttcctcatttgtgaaatggttatcattatagcacgtcccttacagccttgttatgagacttaggcaatagccactagtgcttagaacaaagctatttttgtaactttctccaggaacacttcccttaacagaaccaacccctccacccctcagtttgttcttccctccacaccctctaacattctaacataaccacaaagagtcctgatgggatttggagttacactgcctgggttcgaatctcaattccgccactgccattcgcgcgttttctattgccagccaccttactctcccctggcctcagtttcctcatccttagaaggggagcagagcacatggtggtaactccctgcacattcctctctttccttgtattgggtgcccagtttgtgccctcacatggcgctagcactgagtgggctcaaactctgtacgcgtttactaagcatattgactgaagaaatctggaaacctagtaccgcggcaccatatcgttaccccaaaggaaaatgcatgcacgctgtcagagatgacgaacactgcgtctggaaacttcttaagggcacccacgtgtcctcagctgcagacagcagcgaggagacacccagggaattcgagacagcggaaggcggaagggtcccgcaacaacccaccctccagctcaggtgagttcagagtgagaacgcaccgccaggcttggacaaaggcacccggcctacaccccagcggctccccgccggggcctacgtggacttcagcctccagccacagggacaagagctgctggccagggctgcccgcctgggctcactgcgcctgcgcagtgagcagcgcgccccaggtcttctgcccgggcccactgcgcctgcgcacggagtagtgcactctcgtcggcggcaccggcccactgcgcctgagcacgtagcggtgcatttcgggacctgtagttttccccggcaggacggtagaagtcgtggtttgtgcgcggccaggcgctggagcctccgctgccgggagcagtaagtgtgtgacgtcggggtagaagggagtgacccaaattccaaaagctctttgggatgctgcgatgtcgcggccggccccgcgctcgggttttccctcctagacaaaagtctgccggctcccggtcgcgccgggtcggggatccggaaggtgaaggccgccaggccccacctgcggggcgcccctgctggacctggccgtcgggcgccgtcaacccgttgagcagcgtgttccggctggcacgtggcccgggcggggcccaggattggttcaagcctacggtgttggtccccggagagtctagggagacaagcaatcccctggaatggtgggggaagcgatgacagcccctggtcctcatccgcagctctgggggaagtcggggggtggggagggcgggtgttgctccctgagtgttgggggaagggtatggggagaggaccctgaactagcccccaggttacccaggaggagctgaggcccagagaggttcagcgactcgcccagggttgcacagcgagcacaggcaccgacgtcgccctccgaggcctgggcttccagcagggagagacccggacacctgtcatcgcttctcggtggatccctgaaatgttgagttgtggagtctgggcagctgagatcgggcagggctggtttcttgtaggcccaggcttccgtgtagagggccaagtgatgcccaaggttcacctggcagccccctctctggacctacccctccttatgattgggtgaagggttgggtgaaaagggtagaggccgggaatgagaacagcttcagaaagctcagacaaagggcgcagcatgattcgtggctggaaggagacagcaagcgatagactgatccttgaatttgttagtgtgccaagaagaaaaagtattaatagattgtggacgacacattatccatattgctttagttggtctaaccaaaataagcgaatagcttttttgtttctaagagaaacctgacaaaggaagacagggtatttttgcggtgaaggaaatagaaatatttggagttgtatctaagccacttgttacttttgtgttttaagctaagatcatggataggtccagggaaagttaaaaatttcccgcacttcttagattttatgcccctcaaaaacatccccaccttgttggcttttgcagttcaaccttcagataccagctccctcgtttctaatattgcattaggtgtacatatggcagcagagcaaatagcttactgatacttttagcttttttcttctcatttgcaaaagactctatgaaaatggctggcttgggcatgtaattgaagggaggtggggaaaagtggtaattcagaggcagtgggtgggaatgagcaaagcatgtcagtgtggttcaccctcttgactcccacctcaccacagcccttctgctacaattgcagattgactctaaatatgtttctttcctaaagagcttgaattttatcactccaggtatgaagttgaggcagctgccagtatattttggcagtcaggttctgtgatatcagagaggatggtgaattgtgaattccagagttgcagaattgttctttagattctgattttttaaatgacagcactttggtttggagggttaatgacttaccccaggtcatatgccacaccatgggtaacaccaagagtagagctcagatctccagttgtcctggtcctcaggctactgatctttattccctgccctgctatcttggaatgactgcattttgccctggatgtcgctagcctgtatccttcaggttggcatgtccagtcatggaaggagagagatttaacataacaacaatggctgacattcagtgctttctgtgtgctggccatggtgcttagtgtttacagtctaatctgcaagagaatttacagatgggcaagttgaggctgagagaggccaagtaacttgtccaaggtcacactgctagtgaacatagcacatgttttccagagggccagaccactggatgttttttcattcatttcctcctgtaggatcgttggacctatttctcgttcttgactttgggaatcaatattctacgtacatcaattcactgggtatgcagttttgcctctgaaaattttgagggaacagccagactcatctactgtatttgtatacaactcaattaaagcaggaattgtaaaaataaaatttgtaagatctttaacattttaatatacaacattagctaatcactaagattactagagatactcaaagtgaaaattgtagcaacaggttataacatgttaggagcatatttctttagggcagtcagaatctgctgcttcttaaagacaagtgggccatttacacatgaaggtaacaagcacattcagccaccatcattatagttaaacagatctatgatttaaattcctatcgctaccttatctgactttgaaaaagtcatggggaaaacttggctaccttgtgccaactgctagcttgttttcaagatattataatcttgaatagatggaggatgaactttttatacttagatagctttgtaattgaaagtttgtataaaaacatcttgcctgaagttcatcttatccccattctatctaaaggcctttgaaattttcagccacttttcttaattatgacggtaagtacatttcaagagaagtgtttccctgacttttgaatgcaaagctctctgcctgtgtcaggatggtgccgaggttaaagccctggagccagactggatgggttcgaatcccaggcccacctgcgagaccctcgatgtgttacttaaattttatttcctcctctctaaagtggaggcagtaagctgttttatggggtagttgtgagggctaaatgtcttaactcatctaagcactttagccacttttttccatctgacacaaaaaagttaagctatgattattgtgctataaagcattggatttcagaagaagtaggggcactaaacaccatctgcttgacacctttcttcacttacagatgggactgaagctctagagggaagtcacttaccagagggtgtaggttcttcatccagagctgaagtcttcttgggggtatgtgtcatattctaagagtagggacctacaaggccttggagcgaatcccaaggctcgggctgccagccctgccttctcatttccatatgccatggtgtggcatatgacctggggtaatatcctctgaaccaaagtgctgtcatttaaaaaatcagaatctaaagaacaattctgcaactctggaattcacaattcaccatcctctctgatatcacttccttccctaccttctactaggtctccctcaagctttagagaaaattctgcctctgaattattgcatctgacaatttttctgccctgtcacttattcccttgctcccagataatcttcgaaaaaccaagatgagtttaattaacactcagaggacttgacaaagacactcactcccaaaccagcttgcgtttaggtctggaggcaggtggagggacagattttagacttgggcccttaggttcacagatgaatgggatgggagcccatgtcccctcagaagcggcgctgtgctgctggcggctacagacagctggtgaggagagctttctgcttagcaagggccaggcccgtctgggccctcgcccagcccatccacttcccaccagtctctcaatcgccttgtcaggacacagcccacctctctgtggagctcactttctgttcacattccctctctccatcaaagagacatctttctaaggtggtctgccctagg

SEQ ID NO: 6 - DNA, 10 bp, Artificial Sequence
  Synthetic oligonucleotide
gcgcccgcgg

SEQ ID NO: 7 - DNA, 18 bp, Artificial Sequence
  Synthetic oligonucleotide
gcgcgggcggcgcgggcg

SEQ ID NO: 8 - protein, 6 aa, Artificial Sequence
  Synthetic peptide
GAGGAG

SEQ ID NO: 9 - DNA, 11 bp, Artificial Sequence
  Synthetic oligonucleotide
gccttcgggcc

SEQ ID NO: 10 - DNA, 14 bp, Artificial Sequence
  Synthetic oligonucleotide
gccccggggcgacg

What is claimed is:

1. A method for determining whether a subject suffers from or is predisposed to suffer from congenital long QT syndrome (LQTS) comprising
analyzing a biological sample from a subject for the allele present at KCNQ1 mutations 1075 C>T, 190_210del (in which nucleotides 80718 to 80738 of SEQ ID NO: 1 are deleted), 862_880del (in which nucleotides 208341 to 208359 of SEQ ID NO: 1 are deleted), 1265delA, and 1338 C>G,
detecting in the biological sample any one or more of the KCNQ1 mutations 1075 C>T, 190_210del, 862_880del, 1265delA, and 1338 C>G, and
determining that the subject suffers from or is predisposed to suffer from LQTS when any one or more of the KCNQ1 mutations 1075 C>T, 190_210del, 862_880del, 1265delA, and 1338 C>G is present in the biological sample.

2. A method for detecting a KCNQ1 variant, comprising
analyzing a biological sample from a subject for the allele present at KCNQ1 mutations 1075 C>T, 190_210del (in which nucleotides 80718 to 80738 of SEQ ID NO: 1 are deleted), 862_880del (in which nucleotides 208341 to 208359 of SEQ ID NO: 1 are deleted), 1265delA, and 1338 C>G, and
detecting in the biological sample any one or more of the KCNQ1 mutations 1075 C>T, 190_210del, 862_880del, 1265delA, and 1338 C>G.

3. The method of claim 1 or 2, wherein the analyzing comprises using a technique selected from the group consisting of polymerase chain reaction (PCR) amplification reaction, reverse-transcriptase PCR analysis, single-strand conformation polymorphism analysis (SSCP), mismatch cleavage detection, heteroduplex analysis, Southern blot analysis, Western blot analysis, deoxyribonucleic acid sequencing, restriction fragment length polymorphism analysis, haplotype analysis, serotyping, and combinations or subcombinations thereof.

4. The method of claim 1 or 2, wherein the biological sample from the subject is selected from the group consisting of a fluid, blood fluids, vomit, intra-articular fluid, saliva, lymph, cystic fluid, urine, fluids collected by bronchial lavage, fluids collected by peritoneal rinsing, gynecological fluids, a blood sample or a component thereof, a tissue or component thereof, bone, connective tissue, cartilage, lung, liver, kidney, muscle tissue, heart, pancreas, and skin.

* * * * *